(12) United States Patent
Edwards et al.

(10) Patent No.: US 6,384,208 B1
(45) Date of Patent: May 7, 2002

(54) SEQUENCE DIRECTED DNA BINDING MOLECULES COMPOSITIONS AND METHODS

(75) Inventors: Cynthia A. Edwards, Menlo Park, CA (US); Charles R. Cantor, Boston; Beth M. Andrews, Maynard, both of MA (US); Lisa M. Turin, Redwood City; Kirk E. Fry, Palo Alto, both of CA (US)

(73) Assignee: Genelabs Technologies, Inc., Redwood City, CA (US)

( * ) Notice: Subject to any disclaimer, the term of this patent is extended or adjusted under 35 U.S.C. 154(b) by 0 days.

(21) Appl. No.: 09/354,947

(22) Filed: Jul. 15, 1999

Related U.S. Application Data

(63) Continuation of application No. 08/482,080, filed on Jun. 7, 1995, now Pat. No. 6,010,849, which is a division of application No. 08/171,389, filed on Dec. 20, 1993, now Pat. No. 5,578,444, which is a continuation-in-part of application No. 08/123,936, filed on Sep. 17, 1993, now Pat. No. 5,726,014, which is a continuation-in-part of application No. 07/996,783, filed on Dec. 23, 1992, now Pat. No. 5,693,463, which is a continuation-in-part of application No. 07/723,618, filed on Jun. 27, 1991, now abandoned.

(51) Int. Cl.[7] ............................................. C07H 21/04
(52) U.S. Cl. ..................................... 536/24.1; 536/23.1
(58) Field of Search ............................. 435/6; 536/24.1, 536/23.1

(56) References Cited

U.S. PATENT DOCUMENTS 5,738,990 A * 4/1998 Edwards et al. ............... 435/6

* cited by examiner

*Primary Examiner*—Robert A. Schwartzman
*Assistant Examiner*—Katharine F. Davis
(74) *Attorney, Agent, or Firm*—Gary Fabian; Larry W. Thrower; Perkins Coie LLP

(57) ABSTRACT

The present invention defines a DNA: protein-binding assay useful for screening libraries of synthetic or biological compounds for their ability to bind DNA test sequences. The assay is versatile in that any number of test sequences can be tested by placing the test sequence adjacent to a defined protein binding screening sequence. Binding of molecules to these test sequence changes the binding characteristics of the protein molecule to its cognate binding sequence. When such a molecule binds the test sequence the equilibrium of the DNA:protein complexes is disturbed, generating changes in the concentration of free DNA probe. Numerous exemplary target test sequences (SEQ ID NO:1 to SEQ ID NO:600) are set forth. The assay of the present invention is also useful to characterize the preferred binding sequences of any selected DNA-binding molecule.

1 Claim, 47 Drawing Sheets

|        | Test Sequence: | Screening Sequence: | Test Sequence: |
|--------|---|---|---|

UL9Z1   5'-<u>GCGCGCGCGC</u>GTTCGCACTTCCGCCGCCGG-3'
        Z-DNA

UL9Z2   5'-GGCGCCGGCCGTTCGCACTT<u>CGCGCGCG</u>-3'
                                                    Z-DNA

UL9 CCCG   5'-GGCCCGCCCCGTTCGCACTTCCCGCCCGG-3'

UL9 GGGC   5'-GGCGGGCGCCGTTCGCACTTGGGCGGGCGG-3'

UL9 ATAT   5'-GGATATATACGTTCGCACTTTAATTATTGG-3'

UL9 polyA  5'-GGAAAAAAACGTTCGCACTTAAAAAAAAGG-3'

UL9 polyT  5'-GGTTTTTTTCGTTCGCACTTTTTTTTTTGG-3'

UL9 GCAC   5'-GGACGCACGCGTTCGCACTTGCAGCAGCGG-3'

ATori-1    5'-GCGTATATATCGTTCGCACTTCGTCCCAAT-3' oriEco2    5'-GGCGAATTCGACGTTCGCACTTCGTCCCAAT-3' oriEco3    5'-GGCGAATTCGATCGTTCGCACTTCGTCCCAAT-3'

Fig. 5

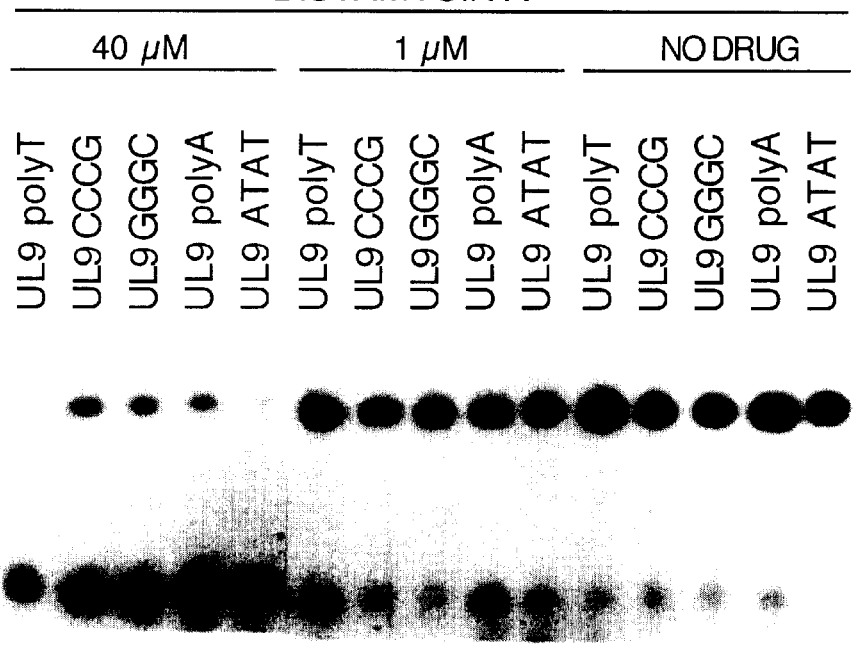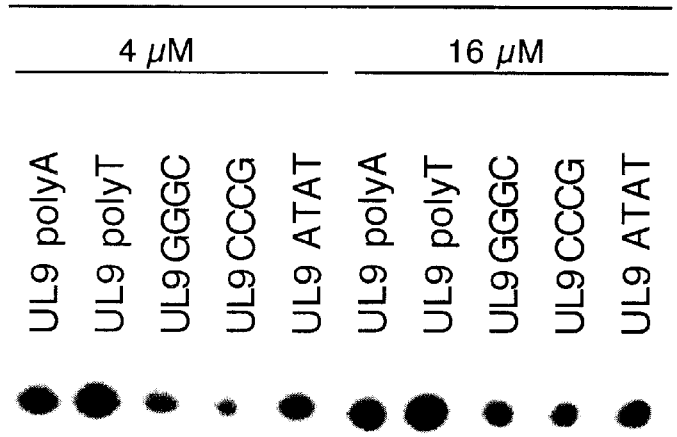
Fig. 10A

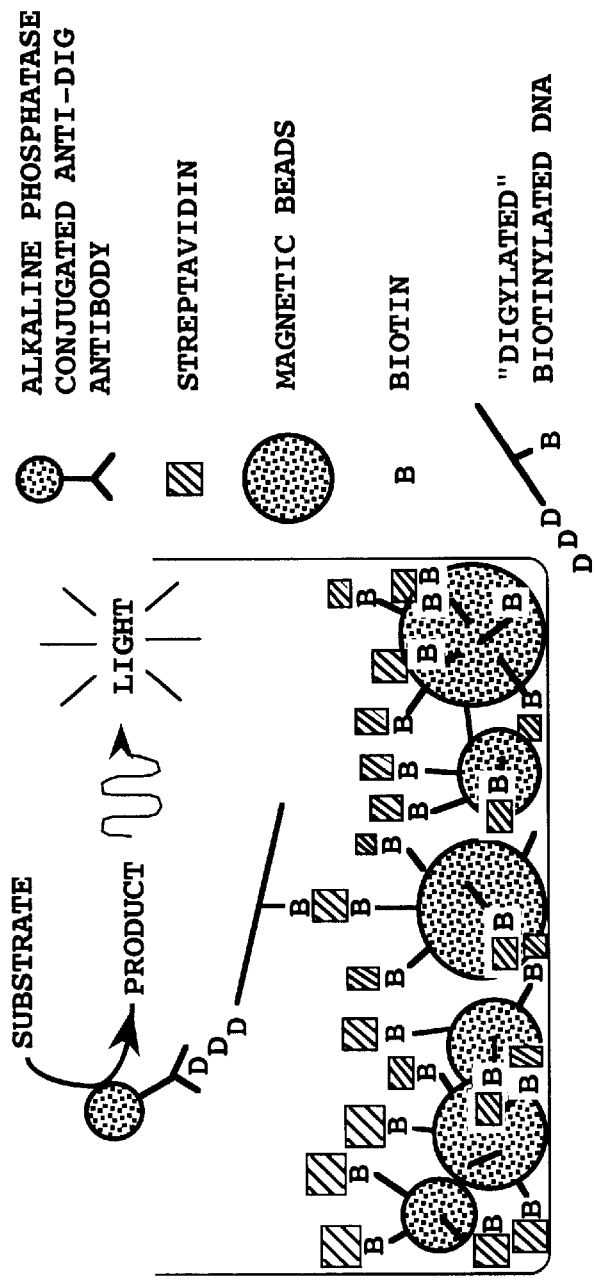
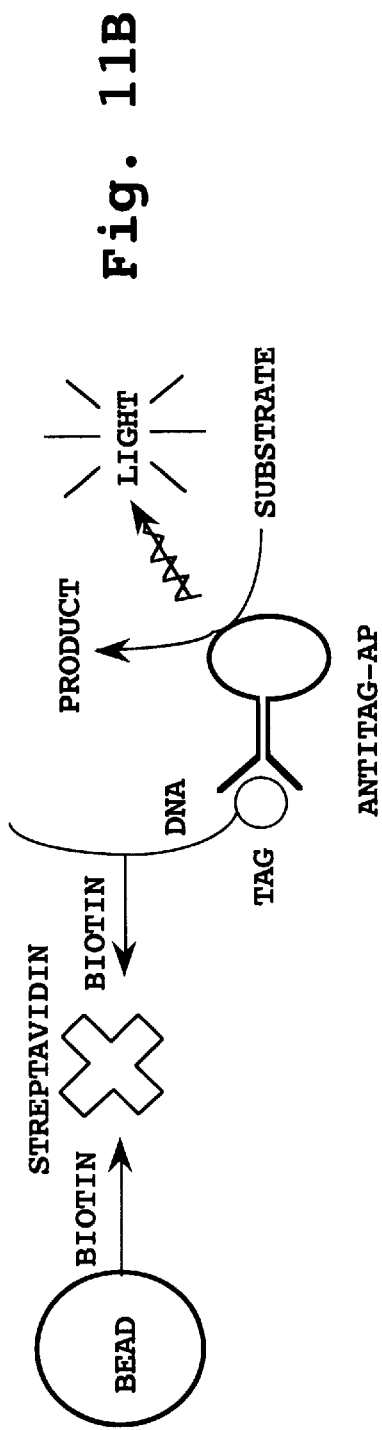
Fig. 11A
Fig. 11B

Fig. 12

| Sequence | \_1\_ | \_2\_ | \_3\_ | \_4\_ | \_5\_ | \_6\_ | \_7\_ | \_8\_ | \_9\_ |
|---|---|---|---|---|---|---|---|---|---|
| AGCTTTCGCACTTAGCT | – | + | + | – | – | – | – | – | – |
| AGCATTCGCACTTAGCA | – | + | – | – | + | + | – | – | – |
| AGCCTTCGCACTTAGCC | – | + | – | – | – | – | – | – | + |
| AGCGTTCGCACTTAGCG | – | + | – | – | – | – | – | + | – |
| TGCTTTCGCACTTTGCT | – | + | – | – | + | – | – | + | – |
| TGCATTCGCACTTTGCA | – | + | – | – | – | + | – | + | + |
| TGCCTTCGCACTTTGCC | – | + | – | – | – | – | – | + | – |
| TGCGTTCGCACTTTGCG | – | + | – | – | – | – | – | – | – |
| ⋯ | ⋯ | ⋯ | ⋯ | ⋯ | ⋯ | ⋯ | ⋯ | ⋯ | ⋯ |
| CCATTTCGCACTTCCAT | – | + | – | – | + | – | – | – | + |
| CCCTTTCGCACTTCCCT | – | + | – | – | – | – | – | + | + |
| CCGTTTCGCACTTCCGT | – | + | – | – | – | – | – | – | + |
| CCTTTTCGCACTTCCTT | – | + | – | – | – | – | – | + | + |
| ⋯ | ⋯ | ⋯ | ⋯ | ⋯ | ⋯ | ⋯ | ⋯ | ⋯ | ⋯ |

Test Mixtures

SEQUENCE

| | | | | | |
|---|---|---|---|---|---|
| AAAA | 001 | ATCG | 055 | CGTA | 109 |
| AAAC | 002 | ATCT | 056 | CGTC | 110 |
| AAAG | 003 | ATGA | 057 | CGTG | 111 |
| AAAT | 004 | ATGC | 058 | CGTT | 112 |
| AACA | 005 | ATGG | 059 | CTAA | 113 |
| AACC | 006 | ATGT | 060 | CTAC | 114 |
| AACG | 007 | ATTA | 061 | CTAG | 115 |
| AACT | 008 | ATTC | 062 | CTAT | 116 |
| AAGA | 009 | ATTG | 063 | CTCA | 117 |
| AAGC | 010 | ATTT | 064 | CTCC | 118 |
| AAGG | 011 | CAAA | 065 | CTCG | 119 |
| AAGT | 012 | CAAC | 066 | CTCT | 120 |
| AATA | 013 | CAAG | 067 | CTGA | 121 |
| AATC | 014 | CAAT | 068 | CTGC | 122 |
| AATG | 015 | CACA | 069 | CTGG | 123 |
| AATT | 016 | CACC | 070 | CTGT | 124 |
| ACAA | 017 | CACG | 071 | CTTA | 125 |
| ACAC | 018 | CACT | 072 | CTTC | 126 |
| ACAG | 019 | CAGA | 073 | CTTG | 127 |
| ACAT | 020 | CAGC | 074 | CTTT | 128 |
| ACCA | 021 | CAGG | 075 | GAAA | 129 |
| ACCC | 022 | CAGT | 076 | GAAC | 130 |
| ACCG | 023 | CATA | 077 | GAAG | 131 |
| ACCT | 024 | CATC | 078 | GAAT | 132 |
| ACGA | 025 | CATG | 079 | GACA | 133 |
| ACGC | 026 | CATT | 080 | GACC | 134 |
| ACGG | 027 | CCAA | 081 | GACG | 135 |
| ACGT | 028 | CCAC | 082 | GACT | 136 |
| ACTA | 029 | CCAG | 083 | GAGA | 137 |
| ACTC | 030 | CCAT | 084 | GAGC | 138 |
| ACTG | 031 | CCCA | 085 | GAGG | 139 |
| ACTT | 032 | CCCC | 086 | GAGT | 140 |
| AGAA | 033 | CCCG | 087 | GATA | 141 |
| AGAC | 034 | CCCT | 088 | GATC | 142 |
| AGAG | 035 | CCGA | 089 | GATG | 143 |
| AGAT | 036 | CCGC | 090 | GATT | 144 |
| AGCA | 037 | CCGG | 091 | GCAA | 145 |
| AGCC | 038 | CCGT | 092 | GCAC | 146 |
| AGCG | 039 | CCTA | 093 | GCAG | 147 |
| AGCT | 040 | CCTC | 094 | GCAT | 148 |
| AGGA | 041 | CCTG | 095 | GCCA | 149 |
| AGGC | 042 | CCTT | 096 | GCCC | 150 |
| AGGG | 043 | CGAA | 097 | GCCG | 151 |
| AGGT | 044 | CGAC | 098 | GCCT | 153 |
| AGTA | 045 | CGAG | 099 | GCGC | 154 |
| AGTC | 046 | CGAT | 100 | GCGG | 155 |
| AGTG | 047 | CGCA | 101 | GCGT | 156 |
| AGTT | 048 | CGCC | 102 | GCTA | 157 |
| ATAA | 049 | CGCG | 103 | GCTC | 158 |
| ATAC | 050 | CGCT | 104 | GCTG | 159 |
| ATAG | 051 | CGGA | 105 | GCTT | 160 |
| ATAT | 052 | CGGC | 106 | GGAA | 161 |
| ATCA | 053 | CGGG | 107 | GGAC | 162 |
| ATCC | 054 | CGGT | 108 | GGAG | 163 |

Fig. 13A

| | | | |
|---|---|---|---|
| GGAT | 164 | TCGC | 218 |
| GGCA | 165 | TCGG | 219 |
| GGCC | 166 | TCGT | 220 |
| GGCG | 167 | TCTA | 221 |
| GGCT | 168 | TCTC | 222 |
| GGGA | 169 | TCTG | 223 |
| GGGC | 170 | TCTT | 224 |
| GGGG | 171 | TGAA | 225 |
| GGGT | 172 | TGAC | 226 |
| GGTA | 173 | TGAG | 227 |
| GGTC | 174 | TGAT | 228 |
| GGTG | 175 | TGCA | 229 |
| GGTT | 176 | TGCC | 230 |
| GTAA | 177 | TGCG | 231 |
| GTAC | 178 | TGCT | 232 |
| GTAG | 179 | TGGA | 233 |
| GTAT | 180 | TGGC | 234 |
| GTCA | 181 | TGGG | 235 |
| GTCC | 182 | TGGT | 236 |
| GTCG | 183 | TGTA | 237 |
| GTCT | 184 | TGTC | 238 |
| GTGA | 185 | TGTG | 239 |
| GTGC | 186 | TGTT | 240 |
| GTGG | 187 | TTAA | 241 |
| GTGT | 188 | TTAC | 242 |
| GTTA | 189 | TTAG | 243 |
| GTTC | 190 | TTAT | 244 |
| GTTG | 191 | TTCA | 245 |
| GTTT | 192 | TTCC | 246 |
| TAAA | 193 | TTCG | 247 |
| TAAC | 194 | TTCT | 248 |
| TAAG | 195 | TTGA | 249 |
| TAAT | 196 | TTGC | 250 |
| TACA | 197 | TTGG | 251 |
| TACC | 198 | TTGT | 252 |
| TACG | 199 | TTTA | 253 |
| TACT | 200 | TTTC | 254 |
| TAGA | 201 | TTTG | 255 |
| TAGC | 202 | TTTT | 256 |
| TAGG | 203 | | |
| TAGT | 204 | | |
| TATA | 205 | | |
| TATC | 206 | | |
| TATG | 207 | | |
| TATT | 208 | | |
| TCAA | 209 | | |
| TCAC | 210 | | |
| TCAG | 211 | | |
| TCAT | 212 | | |
| TCCA | 213 | | |
| TCCC | 214 | | |
| TCCG | 215 | | |
| TCCT | 216 | | |
| TCGA | 217 | | |

Fig. 13B

```
GATC    AGTC    TAGC    CGAT
GACT    AGCT    TACG    CGTA
GTCA    ATCG    TGCA    CATG
GTAC    ATGC    TGAC    CAGT
GCTA    ACTG    TCAG    CTAG
GCAT    ACGT    TCGA    CTGA
```

Fig. 14A

Screening
Sequence

GCGTAN XXXX CGTTCGCACTT XXXX CTTCGTCCCAAT
CGCATN YYYY GCAAGCGTGAA YYYY GAAGCAGGGTTA

Test           Test
    Site           Site

Fig. 14B

| Sort by average rank: | | | | | | | | | |
|---|---|---|---|---|---|---|---|---|---|
| rank | oligo | seqence | %r918 | rank | %r918 | rank | %r1022 | rank | %r1022 | rank | ave. %r | ave rank |
| 1 | 246 | TTCC | 47 | 14 | 44 | 14 | 41 | 4 | 27 | 3 | 40 | 9 |
| 2 | 242 | TTAC | 49 | 19 | 47 | 19 | 55 | 17 | 46 | 15 | 49 | 18 |
| 3 | 198 | TACC | 57 | 43 | 48 | 22 | 50 | 7 | 39 | 10 | 48 | 21 |
| 4 | 206 | TATC | 50 | 20 | 46 | 18 | 54 | 16 | 59 | 45 | 52 | 25 |
| 5 | 7 | AACG | 56 | 38 | 56 | 52 | 48 | 6 | 34 | 4 | 49 | 25 |
| 6 | 247 | TTCG | 56 | 36 | 49 | 26 | 58 | 20 | 54 | 34 | 54 | 29 |
| 7 | 254 | TTTC | 51 | 21 | 35 | 4 | 66 | 46 | 63 | 59 | 54 | 33 |
| 8 | 27 | ACGG | 55 | 30 | 55 | 49 | 63 | 33 | 51 | 24 | 56 | 34 |
| 9 | 202 | TAGC | 65 | 74 | 46 | 16 | 67 | 52 | 18 | 1 | 49 | 36 |
| 10 | 243 | TTAG | 61 | 57 | 53 | 43 | 58 | 21 | 51 | 23 | 56 | 36 |
| 11 | 251 | TTGG | 61 | 59 | 44 | 13 | 60 | 23 | 62 | 53 | 57 | 37 |
| 12 | 194 | TAAC | 66 | 83 | 51 | 35 | 45 | 5 | 52 | 30 | 54 | 38 |
| 13 | 3 | AAAG | 60 | 54 | 58 | 60 | 65 | 37 | 42 | 12 | 56 | 41 |
| 14 | 6 | AACC | 70 | 101 | 56 | 51 | 51 | 9 | 34 | 5 | 53 | 42 |
| 15 | 199 | TACG | 66 | 82 | 53 | 45 | 51 | 8 | 53 | 31 | 56 | 42 |
| 16 | 66 | CAAC | 54 | 27 | 58 | 59 | 70 | 64 | 52 | 29 | 59 | 45 |
| 17 | 34 | AGAC | 55 | 32 | 52 | 41 | 63 | 32 | 67 | 75 | 59 | 45 |
| 18 | 2 | AAAC | 72 | 117 | 50 | 31 | 52 | 12 | 51 | 25 | 56 | 46 |
| 19 | 54 | ATCC | 55 | 29 | 58 | 61 | 75 | 93 | 36 | 7 | 56 | 48 |
| 20 | 11 | AAGG | 68 | 90 | 59 | 62 | 60 | 26 | 48 | 18 | 59 | 49 |
| 21 | 39 | AGCG | 49 | 18 | 53 | 44 | 80 | 138 | 39 | 8 | 55 | 52 |
| 22 | 38 | AGCC | 55 | 34 | 46 | 17 | 80 | 133 | 58 | 41 | 60 | 56 |
| 23 | 195 | TAAG | 70 | 105 | 63 | 72 | 57 | 19 | 54 | 32 | 61 | 57 |
| 24 | 248 | TTCT | 70 | 104 | 52 | 40 | 65 | 38 | 60 | 46 | 61 | 57 |
| 25 | 26 | ACGC | 58 | 45 | 49 | 25 | 78 | 116 | 59 | 44 | 61 | 58 |
| 26 | 22 | ACCC | 64 | 72 | 49 | 28 | 65 | 40 | 71 | 93 | 62 | 58 |
| 27 | 58 | ATGC | 63 | 67 | 65 | 77 | 68 | 53 | 55 | 37 | 63 | 59 |
| 28 | 43 | AGGG | 41 | 6 | 51 | 38 | 86 | 170 | 49 | 21 | 57 | 59 |
| 29 | 214 | TCCC | 68 | 87 | 62 | 70 | 65 | 41 | 58 | 42 | 63 | 60 |
| 30 | 42 | AGGC | 43 | 8 | 49 | 24 | 90 | 195 | 44 | 14 | 56 | 60 |
| 31 | 207 | TATG | 58 | 46 | 67 | 87 | 62 | 29 | 68 | 79 | 64 | 60 |
| 32 | 23 | ACCG | 54 | 25 | 58 | 57 | 80 | 134 | 52 | 26 | 61 | 61 |
| 33 | 51 | ATAG | 48 | 15 | 73 | 111 | 68 | 55 | 63 | 63 | 63 | 61 |
| 34 | 219 | TCGG | 62 | 60 | 74 | 114 | 65 | 36 | 61 | 48 | 65 | 65 |
| 35 | 46 | AGTC | 18 | 2 | 42 | 9 | 74 | 90 | 80 | 160 | 54 | 65 |
| 36 | 249 | TTGA | 71 | 109 | 51 | 36 | 71 | 71 | 62 | 55 | 64 | 68 |
| 37 | 250 | TTGC | 56 | 35 | 50 | 30 | 67 | 49 | 80 | 161 | 63 | 69 |
| 38 | 119 | CTCG | 54 | 26 | 85 | 176 | 61 | 27 | 60 | 47 | 65 | 69 |
| 39 | 55 | ATCG | 56 | 37 | 84 | 169 | 66 | 44 | 52 | 28 | 64 | 70 |
| 40 | 215 | TCCG | 62 | 61 | 58 | 55 | 73 | 81 | 70 | 86 | 66 | 71 |
| 41 | 231 | TGCG | 63 | 66 | 65 | 79 | 70 | 63 | 69 | 83 | 67 | 73 |
| 42 | 161 | GGAA | 43 | 10 | 72 | 107 | 79 | 128 | 67 | 73 | 65 | 80 |
| 43 | 255 | TTTG | 59 | 48 | 51 | 37 | 64 | 35 | 87 | 199 | 65 | 80 |
| 44 | 14 | AATC | 71 | 112 | 50 | 33 | 82 | 152 | 52 | 27 | 64 | 81 |

Fig. 15A

| 45 | 238 | TGTC | 72 | 119 | 64 | 74 | 65 | 42 | 70 | 89 | 68 | 81 |
|---|---|---|---|---|---|---|---|---|---|---|---|---|
| 46 | 35 | AGAG | 56 | 41 | 55 | 47 | 87 | 184 | 62 | 54 | 65 | 82 |
| 47 | 241 | TTAA | 76 | 137 | 84 | 170 | 51 | 10 | 41 | 11 | 63 | 82 |
| 48 | 18 | ACAC | 66 | 80 | 50 | 29 | 97 | 216 | 36 | 6 | 62 | 83 |
| 49 | 47 | AGTG | 51 | 22 | 42 | 10 | 105 | 231 | 65 | 68 | 66 | 83 |
| 50 | 245 | TTCA | 81 | 157 | 66 | 84 | 60 | 25 | 65 | 69 | 68 | 84 |
| 51 | 205 | TATA | 70 | 102 | 66 | 85 | 71 | 70 | 69 | 82 | 69 | 85 |
| 52 | 210 | TCAC | 65 | 75 | 45 | 15 | 21 | 2 | *57.3 | 250 | 43 | 86 |
| 53 | 36 | AGAT | 70 | 100 | 43 | 11 | 102 | 224 | 39 | 9 | 64 | 86 |
| 54 | 244 | TTAT | 80 | 149 | 62 | 69 | 61 | 28 | 71 | 99 | 69 | 86 |
| 55 | 234 | TGGC | 56 | 40 | 61 | 68 | 82 | 150 | 70 | 88 | 67 | 87 |
| 56 | 256 | TTTT | 54 | 28 | 58 | 58 | 71 | 67 | 86 | 195 | 67 | 87 |
| 57 | 193 | TAAA | 74 | 124 | 74 | 117 | 68 | 54 | 63 | 61 | 70 | 89 |
| 58 | 203 | TAGG | 84 | 178 | 59 | 63 | 62 | 30 | 70 | 90 | 69 | 90 |
| 59 | 63 | ATTG | 60 | 51 | 76 | 122 | 80 | 137 | 63 | 56 | 70 | 92 |
| 60 | 227 | TGAG | 75 | 126 | 39 | 6 | 71 | 73 | 81 | 164 | 67 | 92 |
| 61 | 116 | CTAT | 73 | 121 | 74 | 118 | 65 | 43 | 70 | 87 | 71 | 92 |
| 62 | 217 | TCGA | 60 | 53 | 85 | 175 | 69 | 59 | 71 | 95 | 72 | 96 |
| 63 | 59 | ATGG | 62 | 65 | 82 | 150 | 79 | 130 | 56 | 39 | 70 | 96 |
| 64 | 62 | ATTC | 64 | 69 | 71 | 102 | 93 | 203 | 43 | 13 | 68 | 97 |
| 65 | 185 | GTGA | 44 | 12 | 62 | 71 | 76 | 105 | 87 | 201 | 67 | 97 |
| 66 | 61 | ATTA | 77 | 140 | 87 | 179 | 67 | 50 | 49 | 22 | 70 | 98 |
| 67 | 50 | ATAC | 54 | 24 | 71 | 97 | 105 | 232 | 56 | 38 | 71 | 98 |
| 68 | 235 | TGGG | 60 | 52 | 71 | 104 | 78 | 115 | 76 | 121 | 71 | 98 |
| 69 | 166 | GGCC | 80 | 148 | 24 | 1 | 77 | 114 | 77 | 133 | 65 | 99 |
| 70 | 107 | CGGG | 65 | 78 | 100 | 218 | 67 | 51 | 61 | 50 | 73 | 99 |
| 71 | 232 | TGCT | 69 | 97 | 49 | 27 | 73 | 79 | 87 | 198 | 70 | 100 |
| 72 | 158 | GCTC | 33 | 3 | 66 | 83 | 71 | 72 | 131 | 243 | 75 | 100 |
| 73 | 19 | ACAG | 69 | 95 | 65 | 75 | 91 | 197 | 54 | 36 | 70 | 101 |
| 74 | 10 | AAGC | 80 | 151 | 70 | 93 | 73 | 82 | 70 | 85 | 73 | 103 |
| 75 | 208 | TATT | 70 | 106 | 72 | 105 | 75 | 97 | 73 | 105 | 72 | 103 |
| 76 | 1 | AAAA | 83 | 171 | 79 | 137 | 67 | 47 | 63 | 58 | 73 | 103 |
| 77 | 182 | GTCC | 76 | 135 | 60 | 66 | 70 | 65 | 79 | 150 | 71 | 104 |
| 78 | 157 | GCTA | 49 | 16 | 97 | 209 | 77 | 111 | 68 | 81 | 73 | 104 |
| 79 | 191 | GTTG | 110 | 244 | 43 | 12 | 76 | 102 | 63 | 60 | 73 | 105 |
| 80 | 172 | GGGT | 39 | 4 | 58 | 56 | 89 | 192 | 81 | 168 | 67 | 105 |
| 81 | 150 | GCCC | 58 | 44 | 80 | 142 | 86 | 172 | 63 | 62 | 72 | 105 |
| 82 | 15 | AATG | 68 | 88 | 70 | 94 | 108 | 237 | 22 | 2 | 67 | 105 |
| 83 | 196 | TAAT | 94 | 220 | 67 | 86 | 66 | 45 | 67 | 74 | 74 | 106 |
| 84 | 187 | GTGG | 44 | 11 | 100 | 220 | 69 | 58 | 78 | 140 | 73 | 107 |
| 85 | 184 | GTCT | 62 | 62 | 48 | 23 | 77 | 109 | 100 | 236 | 72 | 108 |
| 86 | 115 | CTAG | 70 | 98 | 94 | 203 | 60 | 24 | 73 | 106 | 74 | 108 |
| 87 | 120 | CTCT | 61 | 56 | 114 | 246 | 59 | 22 | 73 | 107 | 77 | 108 |
| 88 | 167 | GGCG | 65 | 73 | 81 | 145 | 80 | 135 | 68 | 80 | 73 | 108 |
| 89 | 239 | TGTG | 72 | 114 | 37 | 5 | 81 | 144 | 82 | 171 | 68 | 109 |
| 90 | 233 | TGGA | 66 | 84 | 65 | 78 | 76 | 106 | 82 | 170 | 72 | 110 |

Fig. 15B

| | | | | | | | | | | | |
|---|---|---|---|---|---|---|---|---|---|---|---|
| 91 | 52 | ATAT | 64 | 70 | 94 | 199 | 78 | 123 | 61 | 49 | 74 | 110 |
| 92 | 220 | TCGT | 73 | 122 | 47 | 21 | 83 | 157 | 78 | 142 | 70 | 111 |
| 93 | 183 | GTCG | 66 | 81 | 83 | 158 | 69 | 57 | 79 | 146 | 74 | 111 |
| 94 | 25 | ACGA | 60 | 55 | 74 | 116 | 100 | 221 | 62 | 52 | 74 | 111 |
| 95 | 226 | TGAC | 71 | 111 | 73 | 110 | 71 | 69 | 80 | 156 | 74 | 112 |
| 96 | 33 | AGAA | 55 | 33 | 82 | 155 | 122 | 246 | 48 | 16 | 77 | 113 |
| 97 | 114 | CTAC | 61 | 58 | 77 | 125 | 54 | 15 | *78.17 | 253 | 84 | 113 |
| 98 | 211 | TCAG | 75 | 130 | 70 | 95 | 75 | 100 | 76 | 126 | 74 | 113 |
| 99 | 104 | CGCT | 69 | 93 | 92 | 194 | 64 | 34 | 77 | 131 | 75 | 113 |
| 100 | 142 | GATC | 64 | 68 | 33 | 3 | 84 | 160 | 92 | 224 | 68 | 114 |
| 101 | 230 | TGCC | 73 | 123 | 60 | 67 | 73 | 77 | 85 | 188 | 73 | 114 |
| 102 | 209 | TCAA | 72 | 115 | 69 | 91 | 84 | 158 | 71 | 92 | 74 | 114 |
| 103 | 162 | GGAC | 41 | 7 | 83 | 157 | 67 | 48 | 149 | 244 | 85 | 114 |
| 104 | 67 | CAAG | 86 | 184 | 66 | 82 | 86 | 174 | 49 | 19 | 72 | 115 |
| 105 | 252 | TTGT | 82 | 162 | 56 | 50 | 77 | 113 | 78 | 136 | 73 | 115 |
| 106 | 222 | TCTC | 69 | 94 | 77 | 127 | 84 | 163 | 68 | 77 | 75 | 115 |
| 107 | 174 | GGTC | 65 | 76 | 107 | 237 | 54 | 14 | 77 | 134 | 76 | 115 |
| 108 | 30 | ACTC | 73 | 120 | 65 | 81 | 131 | 250 | 48 | 17 | 79 | 117 |
| 109 | 71 | CACG | 13 | 1 | 83 | 162 | 88 | 186 | 76 | 122 | 65 | 118 |
| 110 | 45 | AGTA | 60 | 50 | 77 | 126 | 106 | 234 | 64 | 66 | 77 | 119 |
| 111 | 201 | TAGA | 94 | 216 | 77 | 129 | 72 | 75 | 63 | 57 | 76 | 119 |
| 112 | 29 | ACTA | 81 | 153 | 42 | 8 | 131 | 249 | 64 | 67 | 79 | 119 |
| 113 | 24 | ACCT | 56 | 39 | 93 | 195 | 95 | 210 | 54 | 35 | 75 | 120 |
| 114 | 31 | ACTG | 68 | 89 | 73 | 109 | 112 | 240 | 58 | 43 | 78 | 120 |
| 115 | 175 | GGTG | 71 | 110 | 94 | 200 | 55 | 18 | 80 | 158 | 75 | 122 |
| 116 | 131 | GAAG | 69 | 91 | 71 | 100 | 78 | 120 | 83 | 175 | 75 | 122 |
| 117 | 229 | TGCA | 76 | 136 | 83 | 163 | 78 | 118 | 67 | 72 | 76 | 122 |
| 118 | 163 | GGAG | 49 | 17 | 106 | 234 | 69 | 60 | 85 | 184 | 77 | 124 |
| 119 | 90 | CCGC | 83 | 172 | 82 | 148 | 69 | 56 | 75 | 119 | 77 | 124 |
| 120 | 253 | TTTA | 75 | 128 | 72 | 106 | 74 | 85 | 84 | 180 | 76 | 125 |
| 121 | 118 | CTCC | 78 | 142 | 57 | 54 | 75 | 98 | 89 | 207 | 75 | 125 |
| 122 | 151 | GCCG | 52 | 23 | 110 | 243 | 84 | 164 | 67 | 71 | 78 | 125 |
| 123 | 155 | GCGG | 62 | 64 | 69 | 92 | 108 | 236 | 75 | 114 | 79 | 127 |
| 124 | 221 | TCTA | 75 | 134 | 71 | 98 | 82 | 153 | 77 | 129 | 76 | 129 |
| 125 | 179 | GTAG | 141 | 250 | 59 | 64 | 75 | 95 | 73 | 108 | 87 | 129 |
| 126 | 122 | CTGC | 89 | 200 | 76 | 121 | 74 | 91 | 74 | 109 | 78 | 130 |
| 127 | 197 | TACA | 87 | 192 | 88 | 183 | 71 | 68 | 68 | 78 | 79 | 130 |
| 128 | 143 | GATG | 62 | 63 | 57 | 53 | 105 | 229 | 84 | 181 | 77 | 132 |
| 129 | 170 | GGGC | 43 | 9 | 92 | 190 | 78 | 119 | 89 | 209 | 75 | 132 |
| 130 | 44 | AGGT | 65 | 77 | 69 | 90 | 124 | 247 | 75 | 116 | 83 | 133 |
| 131 | 57 | ATGA | 72 | 118 | 88 | 181 | 92 | 201 | 57 | 40 | 77 | 135 |
| 132 | 13 | AATA | 86 | 186 | 106 | 235 | 14 | 1 | 76 | 120 | 70 | 136 |
| 133 | 130 | GAAC | 90 | 205 | 65 | 76 | 80 | 136 | 76 | 125 | 78 | 136 |
| 134 | 236 | TGGT | 75 | 132 | 60 | 65 | 78 | 122 | 92 | 225 | 76 | 136 |
| 135 | 216 | TCCT | 83 | 169 | 71 | 99 | 82 | 149 | 77 | 130 | 78 | 137 |
| 136 | 41 | AGGA | 81 | 158 | 51 | 39 | 151 | 253 | 71 | 97 | 89 | 137 |

Fig. 15C

| 137 | 237 | TGTA | 82 | 166 | 74 | 115 | 74 | 89 | 83 | 178 | 78 | 137 |
|---|---|---|---|---|---|---|---|---|---|---|---|---|
| 138 | 9 | AAGA | 87 | 191 | 78 | 133 | 82 | 154 | 67 | 70 | 79 | 137 |
| 139 | 218 | TCGC | 72 | 113 | 78 | 132 | 75 | 96 | 90 | 211 | 79 | 138 |
| 140 | 56 | ATCT | 75 | 133 | 81 | 146 | 89 | 189 | 69 | 84 | 79 | 138 |
| 141 | 108 | CGGT | 64 | 71 | 94 | 201 | 73 | 78 | 88 | 205 | 80 | 139 |
| 142 | 98 | CGAC | 94 | 219 | 84 | 168 | 54 | 13 | 80 | 159 | 78 | 140 |
| 143 | 145 | GCAA | 57 | 42 | 105 | 230 | 77 | 112 | 84 | 179 | 81 | 141 |
| 144 | 112 | CGTT | 80 | 152 | 82 | 151 | 76 | 101 | 81 | 165 | 80 | 142 |
| 145 | 96 | CCTT | 69 | 92 | 29 | 2 | 106 | 235 | 105 | 241 | 77 | 143 |
| 146 | 48 | AGTT | 70 | 107 | 47 | 20 | 116 | 243 | 87 | 200 | 80 | 143 |
| 147 | 171 | GGGG | 55 | 31 | 112 | 244 | 77 | 107 | 86 | 194 | 82 | 144 |
| 148 | 12 | AAGT | 76 | 138 | 89 | 184 | 102 | 223 | 54 | 33 | 80 | 145 |
| 149 | 154 | GCGC | 89 | 203 | 74 | 113 | 96 | 214 | 62 | 51 | 80 | 145 |
| 150 | 89 | CCGA | 95 | 222 | 50 | 32 | 74 | 88 | 104 | 239 | 81 | 145 |
| 151 | 240 | TGTT | 79 | 146 | 65 | 80 | 86 | 173 | 84 | 183 | 79 | 146 |
| 152 | 79 | CATG | 92 | 209 | 79 | 136 | 78 | 121 | 75 | 118 | 81 | 146 |
| 153 | 165 | GGCA | 60 | 49 | 105 | 232 | 72 | 74 | 95 | 231 | 83 | 147 |
| 154 | 204 | TAGT | 96 | 225 | 86 | 178 | 77 | 108 | 68 | 76 | 81 | 147 |
| 155 | 87 | CCCG | 85 | 182 | 82 | 152 | 73 | 80 | 83 | 174 | 81 | 147 |
| 156 | 200 | TACT | 97 | 230 | 84 | 167 | 74 | 86 | 74 | 110 | 82 | 148 |
| 157 | 132 | GAAT | 75 | 129 | 106 | 236 | 70 | 61 | 81 | 167 | 83 | 148 |
| 158 | 146 | GCAC | 59 | 47 | 115 | 248 | 87 | 183 | 75 | 115 | 84 | 148 |
| 159 | 49 | ATAA | 65 | 79 | 84 | 166 | 128 | 248 | 72 | 102 | 87 | 149 |
| 160 | 4 | AAAT | 86 | 183 | 105 | 231 | 78 | 117 | 64 | 65 | 83 | 149 |
| 161 | 70 | CACC | 89 | 199 | 96 | 207 | 75 | 99 | 71 | 98 | 83 | 151 |
| 162 | 110 | CGTC | 98 | 233 | 92 | 191 | 73 | 83 | 71 | 96 | 83 | 151 |
| 163 | 28 | ACGT | 83 | 168 | 55 | 48 | 146 | 252 | 78 | 138 | 90 | 152 |
| 164 | 8 | AACT | 81 | 160 | 83 | 159 | 84 | 162 | 77 | 128 | 81 | 152 |
| 165 | 92 | CCGT | 81 | 159 | 77 | 130 | 73 | 84 | 102 | 238 | 84 | 153 |
| 166 | 5 | AACA | 83 | 170 | 93 | 197 | 84 | 161 | 71 | 91 | 83 | 155 |
| 167 | 84 | CCAT | 108 | 242 | 54 | 46 | 87 | 177 | 80 | 155 | 82 | 155 |
| 168 | 190 | GTTC | 84 | 174 | 68 | 88 | 85 | 168 | 85 | 192 | 80 | 156 |
| 169 | 160 | GCTT | 44 | 13 | 89 | 186 | 92 | 202 | 92 | 222 | 79 | 156 |
| 170 | 78 | CATC | 92 | 213 | 83 | 161 | 79 | 126 | 76 | 124 | 83 | 156 |
| 171 | 123 | CTGG | 86 | 185 | 89 | 185 | 81 | 145 | 74 | 111 | 83 | 157 |
| 172 | 228 | TGAT | 102 | 240 | 71 | 101 | 81 | 146 | 78 | 143 | 83 | 158 |
| 173 | 135 | GACG | 82 | 164 | 79 | 135 | 89 | 191 | 79 | 147 | 82 | 159 |
| 174 | 149 | GCCA | 70 | 99 | 97 | 210 | 105 | 228 | 72 | 101 | 86 | 160 |
| 175 | 128 | CTTT | 79 | 144 | 77 | 128 | 85 | 169 | 88 | 203 | 82 | 161 |
| 176 | 159 | GCTG | 40 | 5 | 104 | 229 | 86 | 171 | 105 | 240 | 84 | 161 |
| 177 | 17 | ACAA | 82 | 167 | 112 | 245 | 96 | 213 | 49 | 20 | 85 | 161 |
| 178 | 225 | TGAA | 91 | 206 | 76 | 124 | 81 | 140 | 83 | 176 | 83 | 162 |
| 179 | 164 | GGAT | 67 | 86 | 100 | 221 | 82 | 148 | 85 | 191 | 84 | 162 |
| 180 | 178 | GTAC | 92 | 212 | 75 | 120 | 85 | 166 | 79 | 149 | 83 | 162 |
| 181 | 77 | CATA | 155 | 252 | 50 | 34 | 102 | 222 | 78 | 139 | 96 | 162 |
| 182 | 105 | CGGA | 84 | 173 | 110 | 242 | 52 | 11 | 92 | 223 | 84 | 162 |

Fig. 15D

| | | | | | | | | | | | |
|---|---|---|---|---|---|---|---|---|---|---|---|
| 183 | 53 | ATCA | 75 | 131 | 83 | 156 | 105 | 230 | 77 | 135 | 85 | 163 |
| 184 | 40 | AGCT | 75 | 127 | 71 | 103 | 104 | 226 | 87 | 197 | 84 | 163 |
| 185 | 173 | GGTA | 71 | 108 | 96 | 206 | 88 | 187 | 80 | 154 | 83 | 164 |
| 186 | 156 | GCGT | 74 | 125 | 76 | 123 | 119 | 245 | 81 | 162 | 88 | 164 |
| 187 | 88 | CCCT | 88 | 193 | 80 | 138 | 74 | 92 | 101 | 237 | 86 | 165 |
| 188 | 32 | ACTT | 69 | 96 | 82 | 154 | 134 | 251 | 81 | 166 | 92 | 167 |
| 189 | 144 | GATT | 67 | 85 | 80 | 143 | 100 | 220 | 91 | 220 | 85 | 167 |
| 190 | 223 | TCTG | 77 | 139 | 95 | 204 | 77 | 110 | 91 | 217 | 85 | 168 |
| 191 | 134 | GACC | 97 | 229 | 69 | 89 | 87 | 180 | 82 | 173 | 84 | 168 |
| 192 | 75 | CAGG | 96 | 228 | 73 | 108 | 87 | 182 | 79 | 153 | 84 | 168 |
| 193 | 91 | CCGG | 80 | 150 | 81 | 147 | 81 | 141 | 97 | 233 | 85 | 168 |
| 194 | 72 | CACT | 93 | 215 | 107 | 238 | 83 | 156 | 63 | 64 | 87 | 168 |
| 195 | 153 | GCGA | 72 | 116 | 100 | 219 | 111 | 239 | 72 | 103 | 89 | 169 |
| 196 | 192 | GTTT | 125 | 248 | 74 | 119 | 84 | 159 | 79 | 151 | 91 | 169 |
| 197 | 137 | GAGA | 89 | 201 | 40 | 7 | 103 | 225 | *248.59 | 248 | 78 | 170 |
| 198 | 127 | CTTG | 81 | 156 | 92 | 193 | 82 | 151 | 85 | 185 | 85 | 171 |
| 199 | 93 | CCTA | 86 | 187 | 92 | 192 | 76 | 103 | 88 | 204 | 86 | 172 |
| 200 | 176 | GGTT | 117 | 246 | 70 | 96 | 81 | 142 | 88 | 202 | 89 | 172 |
| 201 | 213 | TCCA | 77 | 141 | 78 | 134 | 87 | 178 | 99 | 234 | 85 | 172 |
| 202 | 60 | ATGT | 79 | 145 | 83 | 160 | 116 | 242 | 78 | 141 | 89 | 172 |
| 203 | 125 | CTTA | 86 | 189 | 52 | 42 | 95 | 211 | *79.5 | 254 | 78 | 174 |
| 204 | 168 | GGCT | 101 | 239 | 85 | 172 | 79 | 129 | 80 | 157 | 86 | 174 |
| 205 | 139 | GAGG | 92 | 210 | 94 | 198 | 85 | 167 | 76 | 123 | 87 | 175 |
| 206 | 147 | GCAG | 70 | 103 | 120 | 251 | 90 | 196 | 79 | 152 | 90 | 176 |
| 207 | 37 | AGCA | 79 | 143 | 81 | 144 | 94 | 207 | 89 | 210 | 86 | 176 |
| 208 | 101 | CGCA | 79 | 147 | 88 | 182 | 78 | 124 | *65.76 | 252 | 82 | 176 |
| 209 | 224 | TCTT | 93 | 214 | 73 | 112 | 84 | 165 | 91 | 216 | 85 | 177 |
| 210 | 103 | CGCG | 91 | 207 | 116 | 250 | 62 | 31 | 91 | 219 | 90 | 177 |
| 211 | 180 | GTAT | 179 | 254 | 100 | 216 | 75 | 94 | 79 | 144 | 108 | 177 |
| 212 | 64 | ATTT | 84 | 175 | 83 | 165 | 94 | 208 | 82 | 172 | 86 | 180 |
| 213 | 141 | GATA | 95 | 224 | 82 | 153 | 91 | 200 | 79 | 145 | 87 | 181 |
| 214 | 140 | GAGT | 117 | 245 | 63 | 73 | 96 | 215 | 85 | 189 | 90 | 181 |
| 215 | 169 | GGGA | 82 | 165 | 145 | 254 | 89 | 190 | 75 | 113 | 98 | 181 |
| 216 | 97 | CGAA | 153 | 251 | 101 | 223 | 24 | 3 | 798 | 246 | 269 | 181 |
| 217 | 94 | CCTC | 92 | 211 | 82 | 149 | 86 | 175 | 85 | 190 | 86 | 181 |
| 218 | 186 | GTGC | 205 | 255 | 356 | 256 | 74 | 87 | 77 | 127 | 178 | 181 |
| 219 | 82 | CCAC | 97 | 232 | 85 | 174 | 80 | 131 | 86 | 193 | 87 | 183 |
| 220 | 113 | CTAA | 85 | 180 | 109 | 240 | 70 | 62 | *60.31 | 251 | 88 | 183 |
| 221 | 212 | TCAT | 89 | 198 | 77 | 131 | 89 | 193 | 91 | 215 | 87 | 184 |
| 222 | 65 | CAAA | 84 | 179 | 116 | 249 | 95 | 209 | 72 | 100 | 92 | 184 |
| 223 | 99 | CGAG | 103 | 241 | 99 | 215 | 65 | 39 | 180 | 245 | 112 | 185 |
| 224 | 102 | CGCC | 88 | 195 | 106 | 233 | 70 | 66 | *35.62 | 249 | 88 | 186 |
| 225 | 76 | CAGT | 96 | 227 | 85 | 177 | 93 | 205 | 78 | 137 | 88 | 187 |
| 226 | 126 | CTTC | 81 | 161 | 90 | 187 | 81 | 147 | *88.2 | 256 | 84 | 188 |
| 227 | 21 | ACCA | 85 | 181 | 99 | 213 | 113 | 241 | 75 | 117 | 93 | 188 |
| 228 | 189 | GTTA | 178 | 253 | 210 | 255 | 81 | 143 | 72 | 104 | 135 | 189 |

Fig. 15E

| 229 | 69 | CACA | 82 | 163 | 83 | 164 | 98 | 219 | 90 | 212 | 88 | 190 |
|---|---|---|---|---|---|---|---|---|---|---|---|---|
| 230 | 111 | CGTG | 81 | 155 | 109 | 239 | 81 | 139 | 93 | 227 | 91 | 190 |
| 231 | 138 | GAGC | 84 | 176 | 80 | 139 | 91 | 199 | *171.29 | 247 | 85 | 190 |
| 232 | 100 | CGAT | 89 | 202 | 80 | 141 | 163 | 255 | 81 | 163 | 103 | 190 |
| 233 | 74 | CAGC | 95 | 223 | 94 | 202 | 78 | 125 | 90 | 213 | 89 | 191 |
| 234 | 106 | CGGC | 99 | 236 | 98 | 211 | 93 | 204 | 75 | 112 | 91 | 191 |
| 235 | 129 | GAAA | 87 | 190 | 93 | 196 | 87 | 185 | 87 | 196 | 89 | 192 |
| 236 | 181 | GTCA | 98 | 234 | 98 | 212 | 76 | 104 | 91 | 218 | 91 | 192 |
| 237 | 73 | CAGA | 97 | 231 | 102 | 226 | 98 | 217 | 71 | 94 | 92 | 192 |
| 238 | 20 | ACAT | 89 | 196 | 91 | 188 | 109 | 238 | 79 | 148 | 92 | 193 |
| 239 | 83 | CCAG | 90 | 204 | 85 | 171 | 96 | 212 | 85 | 186 | 89 | 193 |
| 240 | 152 | GCCT | 88 | 194 | 91 | 189 | 94 | 206 | 85 | 187 | 89 | 194 |
| 241 | 95 | CCTG | 89 | 197 | 85 | 173 | 87 | 179 | 99 | 235 | 90 | 196 |
| 242 | 148 | GCAT | 94 | 218 | 100 | 217 | 98 | 218 | 77 | 132 | 92 | 196 |
| 243 | 81 | CCAA | 91 | 208 | 101 | 224 | 88 | 188 | 83 | 177 | 91 | 199 |
| 244 | 177 | GTAA | 130 | 249 | 133 | 252 | 79 | 127 | 81 | 169 | 106 | 199 |
| 245 | 117 | CTCA | 81 | 154 | 101 | 222 | 89 | 194 | 95 | 230 | 91 | 200 |
| 246 | 109 | CGTA | 120 | 247 | 115 | 247 | 72 | 76 | 97 | 232 | 101 | 201 |
| 247 | 121 | CTGA | 101 | 238 | 95 | 205 | 87 | 181 | 84 | 182 | 92 | 202 |
| 248 | 16 | AATT | 96 | 226 | 80 | 140 | 117 | 244 | 89 | 206 | 95 | 204 |
| 249 | 86 | CCCC | 84 | 177 | 103 | 228 | 91 | 198 | 93 | 226 | 93 | 207 |
| 250 | 85 | CCCA | 99 | 237 | 102 | 225 | 83 | 155 | 115 | 242 | 100 | 215 |
| 251 | 188 | GTGT | 217 | 256 | 136 | 253 | 80 | 132 | 92 | 221 | 131 | 216 |
| 252 | 124 | CTGT | 94 | 221 | 96 | 208 | 106 | 233 | 89 | 208 | 96 | 218 |
| 253 | 133 | GACA | 108 | 243 | 110 | 241 | 87 | 176 | 90 | 214 | 99 | 219 |
| 254 | 136 | GACT | 86 | 188 | 103 | 227 | 159 | 254 | 93 | 228 | 110 | 224 |
| 255 | 68 | CAAT | 99 | 235 | 99 | 214 | 105 | 227 | 94 | 229 | 99 | 226 |
| 256 | 80 | CATT | 94 | 217 | 87 | 180 | 348 | 256 | *838.83 | 255 | 176 | 227 |

Fig. 15F

| Rank Order | oligo | seqence | Screen A %R | Rank | Screen B %R | Rank | Screen C %R | Rank | Screen D %R | Rank | Screen E %R | Rank | Screen F %R | Rank | Screen G %R | Rank | Screen H %R | Rank |
|---|---|---|---|---|---|---|---|---|---|---|---|---|---|---|---|---|---|---|
| 1 | 155 | GCGG | 60.57 | 59 | 46.11 | 4 | 37.63 | 2 | 44.02 | 23 | 42.29 | 4 | 38.20 | 8 | 34.00 | 2 | 29.96 | 4 |
| 2 | 153 | GCGA | 39.38 | 5 | 58.55 | 13 | 48.16 | 8 | 53.50 | 42 | 55.55 | 23 | 45.91 | 17 | 34.13 | 4 | 23.44 | 2 |
| 3 | 145 | GCAA | 50.93 | 23 | 62.15 | 18 | 52.78 | 15 | 54.21 | 45 | 40.63 | 2 | 53.49 | 37 | 34.10 | 3 | 34.92 | 8 |
| 4 | 156 | GCGT | 60.46 | 57 | 67.86 | 32 | N/A | N/A | 43.71 | 22 | 54.34 | 20 | 27.70 | 1 | 36.75 | 5 | 30.84 | 6 |
| 5 | 151 | GCCG | 40.61 | 6 | 56.30 | 9 | 56.74 | 25 | 52.18 | 38 | 62.62 | 46 | 51.43 | 31 | 38.12 | 6 | 29.18 | 3 |
| 6 | 75 | CAGG | 44.18 | 13 | 66.99 | 30 | 56.07 | 24 | 42.54 | 20 | 60.96 | 43 | 45.78 | 15 | 52.39 | 30 | 38.96 | 12 |
| 7 | 146 | GCAC | 59.55 | 49 | 67.11 | 31 | 48.36 | 9 | 52.23 | 39 | 53.97 | 18 | 49.68 | 25 | 31.57 | 1 | 41.08 | 16 |
| 8 | 148 | GCAT | 48.01 | 20 | 44.74 | 3 | 47.41 | 7 | 37.09 | 13 | 48.95 | 10 | 72.50 | 113 | 46.77 | 17 | 30.33 | 5 |
| 9 | 149 | GCCA | 41.26 | 8 | 71.02 | 57 | 57.71 | 28 | 56.10 | 52 | 52.77 | 13 | 45.84 | 16 | 45.61 | 14 | 38.90 | 11 |
| 10 | 123 | CTGG | 41.41 | 9 | 47.23 | 5 | 52.90 | 16 | 38.33 | 15 | 57.05 | 27 | 45.98 | 18 | 63.29 | 95 | 54.06 | 51 |
| 11 | 150 | GCCC | 62.68 | 67 | 71.19 | 58 | 47.09 | 6 | 51.80 | 36 | 53.27 | 15 | 39.32 | 9 | 48.13 | 21 | 44.99 | 25 |
| 12 | 159 | GCTG | 52.56 | 28 | 75.16 | 89 | 68.03 | 67 | 35.56 | 11 | 50.54 | 12 | 42.24 | 12 | 45.75 | 15 | 36.09 | 10 |
| 13 | 171 | GGGG | 64.05 | 79 | 67.88 | 33 | 54.73 | 20 | 31.55 | 5 | 58.61 | 32 | 47.56 | 20 | 48.91 | 26 | 47.67 | 30 |
| 14 | 170 | GGGC | 59.34 | 47 | 69.04 | 47 | 64.46 | 51 | 48.86 | 28 | 54.20 | 19 | 49.88 | 26 | 44.85 | 12 | 44.06 | 22 |
| 15 | 90 | CCGC | 38.78 | 4 | 74.60 | 81 | 55.26 | 22 | 50.57 | 31 | 67.01 | 61 | 36.91 | 6 | N/A | N/A | 44.71 | 23 |
| 16 | 147 | GCAG | 60.36 | 54 | 78.98 | 126 | 51.43 | 13 | 48.35 | 27 | 41.47 | 3 | N/A | N/A | 42.29 | 9 | 17.89 | 1 |
| 17 | 160 | GCTT | 65.45 | 86 | 60.43 | 17 | 44.44 | 5 | 43.40 | 21 | 59.36 | 36 | 60.80 | 65 | 49.31 | 27 | 43.52 | 20 |
| 18 | 152 | GCCT | 66.55 | 91 | 58.49 | 12 | N/A | N/A | 46.77 | 25 | 59.52 | 38 | 59.72 | 61 | 39.45 | 7 | 39.31 | 15 |
| 19 | 161 | GGAA | 57.36 | 40 | 71.27 | 60 | 55.18 | 21 | 55.13 | 47 | 56.33 | 24 | 49.55 | 24 | 55.07 | 38 | 51.67 | 39 |
| 20 | 157 | GCTA | 59.75 | 51 | 75.10 | 87 | 61.83 | 39 | 53.52 | 43 | 56.75 | 25 | 53.54 | 38 | 43.75 | 11 | 39.02 | 13 |
| 21 | 84 | CCAT | 45.31 | 16 | 74.70 | 83 | 50.42 | 10 | 58.54 | 56 | 62.42 | 45 | N/A | N/A | 48.20 | 22 | N/A | N/A |
| 22 | 122 | CTGC | 43.98 | 12 | 84.23 | 168 | 25.02 | 1 | 33.34 | 7 | 59.29 | 34 | 52.36 | 34 | 54.94 | 37 | 44.90 | 24 |
| 23 | 158 | GCTC | 57.76 | 44 | 77.87 | 114 | 60.68 | 31 | 55.48 | 49 | 56.77 | 26 | 53.87 | 40 | 46.64 | 16 | 46.27 | 28 |
| 24 | 162 | GGAC | 55.84 | 35 | 64.55 | 23 | 61.23 | 36 | 50.92 | 34 | 66.79 | 58 | 62.93 | 71 | 59.85 | 70 | 54.50 | 52 |
| 25 | 194 | TAAC | 44.69 | 15 | 68.08 | 37 | 37.70 | 3 | 60.31 | 67 | 57.80 | 30 | 73.92 | 123 | 56.25 | 45 | 56.29 | 61 |

Fig. 18A(1)

| | | | | | | | | | | | | | | | | | | |
|---|---|---|---|---|---|---|---|---|---|---|---|---|---|---|---|---|---|---|
| 26 | 154 | GCGC | 56.47 | 36 | 95.76 | 233 | 66.07 | 56 | 47.44 | 26 | 28.56 | 1 | 35.46 | 4 | 43.03 | 10 | 42.84 | 17 |
| 27 | 164 | GGAT | 60.37 | 55 | 77.48 | 112 | 51.38 | 12 | 55.13 | 48 | 63.83 | 50 | 52.73 | 35 | 55.54 | 39 | 49.89 | 33 |
| 28 | 174 | GGTC | 72.42 | 134 | 59.19 | 15 | 62.18 | 40 | 53.34 | 41 | 66.26 | 56 | 54.10 | 41 | 54.49 | 34 | 50.30 | 35 |
| 29 | 163 | GGAG | 59.48 | 48 | 72.78 | 72 | 65.90 | 54 | 60.50 | 68 | 65.59 | 54 | 62.54 | 70 | 56.87 | 48 | 42.89 | 18 |
| 30 | 119 | CTCG | 51.75 | 26 | 51.20 | 7 | 67.33 | 62 | 37.20 | 14 | 79.06 | 159 | 57.10 | 55 | 59.60 | 67 | 53.13 | 46 |
| 31 | 120 | CTCT | 60.01 | 52 | 63.68 | 22 | 53.91 | 18 | 27.93 | 2 | 110.40 | 237 | 44.83 | 13 | 47.47 | 19 | 58.88 | 78 |
| 32 | 176 | GGTT | 71.11 | 126 | 70.88 | 55 | 71.18 | 89 | 33.44 | 8 | 67.62 | 65 | 56.34 | 51 | 48.78 | 25 | 45.94 | 27 |
| 33 | 92 | CCGT | 41.58 | 10 | 31.15 | 1 | 66.84 | 58 | 63.24 | 89 | 73.85 | 116 | 68.91 | 88 | 61.63 | 80 | 50.58 | 36 |
| 34 | 74 | CAGC | 59.24 | 46 | 75.14 | 88 | 61.63 | 38 | 49.93 | 30 | 69.51 | 76 | 54.13 | 42 | 63.97 | 105 | 55.24 | 57 |
| 35 | 118 | CTCC | 61.32 | 61 | 39.91 | 2 | 160.43 | 230 | 49.60 | 29 | 44.22 | 6 | 57.04 | 54 | 58.85 | 62 | 52.10 | 40 |
| 36 | 195 | TAAG | 60.56 | 58 | 68.82 | 46 | 67.37 | 63 | N/A | N/A | 71.34 | 92 | 67.95 | 82 | 57.63 | 52 | 48.79 | 32 |
| 37 | 172 | GGGT | 68.78 | 106 | 51.13 | 6 | N/A | N/A | N/A | N/A | 78.73 | 158 | 62.08 | 68 | 45.43 | 13 | 39.11 | 14 |
| 38 | 97 | CGAA | 40.88 | 7 | 108.66 | 250 | 62.54 | 43 | 34.55 | 9 | 45.87 | 8 | N/A | N/A | 56.12 | 43 | 57.53 | 69 |
| 39 | 78 | CATC | 53.97 | 31 | 75.77 | 93 | 70.36 | 79 | 45.96 | 24 | 64.06 | 51 | 55.29 | 44 | N/A | N/A | 63.57 | 120 |
| 40 | 173 | GGTA | 70.86 | 120 | 72.53 | 69 | 54.30 | 19 | 50.71 | 33 | 71.76 | 97 | 38.16 | 7 | 72.85 | 186 | 51.58 | 38 |
| 41 | 190 | GTTC | 65.87 | 89 | 62.58 | 20 | 56.80 | 26 | 70.38 | 146 | 49.41 | 11 | 72.27 | 111 | 63.68 | 98 | 58.47 | 75 |
| 42 | 26 | ACGC | 68.19 | 102 | 70.11 | 51 | 65.99 | 55 | 38.55 | 16 | 67.75 | 66 | 87.20 | 203 | 53.17 | 31 | 54.69 | 53 |
| 43 | 94 | CCTC | 77.84 | 176 | 78.45 | 118 | 69.99 | 74 | 53.25 | 40 | 55.10 | 21 | 68.33 | 85 | 50.77 | 28 | 52.54 | 41 |
| 44 | 193 | TAAA | 62.35 | 65 | 66.98 | 29 | 62.47 | 42 | 81.83 | 220 | 48.32 | 9 | 72.13 | 107 | 41.67 | 8 | 63.60 | 121 |
| 45 | 98 | CGAC | 43.00 | 11 | 76.73 | 102 | N/A | N/A | 66.67 | 122 | 57.17 | 28 | 77.94 | 155 | 59.62 | 68 | 53.99 | 48 |
| 46 | 91 | CCGG | 37.67 | 3 | 77.48 | 111 | N/A | N/A | 60.54 | 69 | 52.81 | 14 | N/A | N/A | 79.40 | 222 | 52.95 | 44 |
| 47 | 243 | TTAG | 51.43 | 25 | 62.56 | 19 | 105.85 | 217 | 54.83 | 46 | 68.07 | 68 | 75.78 | 134 | 60.31 | 71 | 53.08 | 45 |
| 48 | 166 | GGCC | 63.70 | 76 | 83.98 | 164 | 55.83 | 23 | 73.29 | 176 | 53.29 | 16 | 47.93 | 22 | 60.94 | 74 | 61.57 | 101 |
| 49 | 244 | TTAT | 67.43 | 97 | 54.61 | 8 | 76.26 | 128 | 60.11 | 64 | 73.07 | 109 | 79.43 | 165 | 58.05 | 58 | 48.32 | 31 |
| 50 | 196 | TAAT | 78.47 | 179 | 66.80 | 28 | 51.75 | 14 | N/A | N/A | 69.98 | 79 | 82.49 | 185 | 56.19 | 44 | 55.14 | 55 |
| 51 | 82 | CCAC | 73.84 | 144 | 83.47 | 159 | 86.64 | 187 | 55.84 | 51 | 43.07 | 5 | 61.83 | 67 | 54.65 | 36 | 43.50 | 19 |
| 52 | 138 | GAGC | 65.53 | 88 | 84.11 | 165 | 71.29 | 91 | 60.24 | 66 | 58.70 | 33 | 41.87 | 11 | 69.61 | 152 | 57.12 | 67 |

Fig. 18A(2)

| | | | | | | | | | | | | | | | | |
|---|---|---|---|---|---|---|---|---|---|---|---|---|---|---|---|---|
| 53 | 71 | CACG | 67.02 | 94 | 69.66 | 49 | 57.96 | 29 | 62.29 | 81 | 71.29 | 88 | 56.54 | 52 | 57.97 | 55 | 83.33 | 228 |
| 54 | 202 | TAGC | 81.74 | 206 | 83.44 | 158 | 74.12 | 110 | 30.93 | 4 | 57.63 | 29 | 51.92 | 33 | 53.78 | 32 | 62.78 | 111 |
| 55 | 250 | TTGC | 75.37 | 156 | 87.05 | 186 | 72.08 | 97 | 29.06 | 3 | 71.76 | 96 | 64.95 | 73 | 57.02 | 49 | 46.82 | 29 |
| 56 | 27 | ACGG | 66.61 | 92 | 80.03 | 133 | 71.62 | 93 | 67.29 | 126 | 45.40 | 7 | 81.44 | 180 | 57.66 | 53 | 34.56 | 7 |
| 57 | 57 | ATGA | 77.49 | 168 | 90.13 | 210 | 62.87 | 45 | 63.06 | 86 | 73.29 | 111 | 51.51 | 32 | 47.38 | 18 | 43.87 | 21 |
| 58 | 132 | GAAT | 73.50 | 141 | 86.93 | 184 | 62.25 | 41 | 56.35 | 53 | 77.91 | 153 | 33.80 | 3 | 59.09 | 64 | 55.79 | 59 |
| 59 | 251 | TTGG | 69.22 | 111 | 59.03 | 14 | N/A | N/A | 61.91 | 77 | 75.50 | 128 | 79.60 | 166 | 62.10 | 84 | 52.61 | 42 |
| 60 | 186 | GTGC | 50.43 | 22 | 77.20 | 105 | N/A | N/A | 77.04 | 198 | N/A | N/A | 55.38 | 45 | 61.30 | 77 | 60.15 | 88 |
| 61 | 180 | GTAT | 69.01 | 108 | 77.53 | 113 | N/A | N/A | 62.19 | 79 | 70.37 | 81 | 51.35 | 30 | 61.06 | 75 | 66.70 | 143 |
| 62 | 30 | ACTC | 63.85 | 78 | 71.43 | 61 | 76.78 | 133 | 73.84 | 180 | 72.55 | 104 | 55.77 | 47 | 61.40 | 78 | 53.99 | 49 |
| 63 | 4 | AAAT | 73.87 | 146 | 68.75 | 44 | 63.52 | 46 | N/A | N/A | 68.90 | 71 | 80.07 | 168 | 59.68 | 69 | 63.55 | 119 |
| 64 | 140 | GAGT | 65.50 | 87 | 68.60 | 43 | 81.50 | 168 | 68.10 | 131 | 55.38 | 22 | 72.01 | 106 | 69.75 | 154 | 56.56 | 62 |
| 65 | 31 | ACTG | 77.20 | 167 | 73.83 | 77 | 117.29 | 221 | 54.07 | 44 | 71.45 | 93 | 58.57 | 58 | 56.10 | 42 | 59.14 | 79 |
| 66 | 178 | GTAC | 61.36 | 62 | 71.74 | 63 | 93.90 | 205 | 64.94 | 103 | 60.33 | 41 | 69.14 | 89 | 66.03 | 126 | 61.09 | 98 |
| 67 | 175 | GGTG | 68.31 | 104 | 86.21 | 181 | 110.54 | 220 | 68.74 | 137 | 63.73 | 48 | 55.88 | 48 | 48.69 | 24 | 45.23 | 26 |
| 68 | 7 | AACG | 68.40 | 105 | 83.42 | 156 | 72.35 | 99 | 69.29 | 142 | 72.53 | 103 | 53.85 | 39 | 61.67 | 81 | 56.74 | 64 |
| 69 | 79 | CATG | 57.47 | 41 | 95.73 | 231 | N/A | N/A | 62.70 | 82 | 59.31 | 35 | N/A | N/A | 56.67 | 46 | 68.61 | 164 |
| 70 | 255 | TTTG | 71.02 | 122 | 102.27 | 247 | 64.12 | 50 | 59.40 | 61 | 59.82 | 39 | 72.54 | 114 | 63.90 | 102 | 57.10 | 66 |
| 71 | 29 | ACTA | 65.30 | 85 | 71.48 | 62 | 85.39 | 185 | 63.66 | 92 | 82.22 | 179 | 51.02 | 29 | 61.85 | 83 | 60.07 | 87 |
| 72 | 256 | TTTT | 73.85 | 145 | 88.88 | 200 | 72.92 | 104 | 60.98 | 71 | 60.55 | 42 | 76.19 | 138 | 56.85 | 47 | 55.49 | 58 |
| 73 | 77 | CATA | 45.90 | 17 | 76.72 | 101 | 63.84 | 47 | 62.16 | 78 | 67.89 | 67 | N/A | N/A | 74.86 | 200 | 76.18 | 199 |
| 74 | 83 | CCAG | 31.15 | 1 | 58.14 | 11 | N/A | N/A | 63.10 | 87 | 81.37 | 176 | 67.36 | 81 | 71.18 | 174 | 71.90 | 179 |
| 75 | 247 | TTCG | 69.06 | 109 | 60.09 | 16 | 166.33 | 231 | 68.62 | 136 | 74.92 | 122 | 59.22 | 60 | 57.85 | 54 | 60.23 | 90 |
| 76 | 76 | CAGT | 52.35 | 27 | 68.33 | 39 | 69.51 | 73 | 84.51 | 223 | 62.64 | 47 | 73.72 | 122 | 70.33 | 165 | 64.84 | 129 |
| 77 | 93 | CCTA | 51.13 | 24 | 89.50 | 207 | 70.81 | 85 | 65.38 | 107 | N/A | N/A | 47.85 | 21 | 74.06 | 194 | 59.98 | 85 |
| 78 | 18 | ACAC | 91.71 | 246 | 72.56 | 70 | N/A | N/A | 61.60 | 74 | 63.79 | 49 | 77.56 | 152 | 60.48 | 73 | 57.57 | 70 |
| 79 | 96 | CCTT | 67.50 | 98 | 87.74 | 192 | 80.15 | 160 | 35.55 | 10 | 75.52 | 129 | N/A | N/A | 55.86 | 41 | N/A | N/A |

Fig. 18A(3)

| # | | Tetramer | | | | | | | | | | | | | | | | |
|---|---|---|---|---|---|---|---|---|---|---|---|---|---|---|---|---|---|---|
| 80 | 198 | TACC | 79.63 | 189 | 83.31 | 154 | 67.73 | 65 | 58.29 | 54 | 53.62 | 17 | 75.92 | 135 | 64.41 | 110 | 63.37 | 117 |
| 81 | 188 | GTGT | 66.82 | 93 | 65.68 | 27 | N/A | N/A | 60.60 | 70 | 83.11 | 186 | 76.88 | 144 | 67.53 | 137 | 59.33 | 80 |
| 82 | 131 | GAAG | 71.56 | 129 | 56.81 | 10 | 77.86 | 146 | 162.35 | 244 | 69.45 | 75 | 67.31 | 80 | 64.55 | 113 | 54.04 | 50 |
| 83 | 58 | ATGC | 79.53 | 187 | 82.93 | 151 | 103.10 | 216 | 63.78 | 94 | 61.71 | 44 | 46.36 | 19 | 51.19 | 29 | 62.86 | 113 |
| 84 | 10 | AAGC | 85.40 | 222 | 89.00 | 201 | 80.61 | 163 | 61.87 | 75 | N/A | N/A | 57.84 | 57 | 47.53 | 20 | 36.08 | 9 |
| 85 | 102 | CGCC | 63.63 | 75 | 78.60 | 120 | 71.74 | 94 | 69.04 | 140 | 85.17 | 199 | 63.39 | 72 | 57.14 | 50 | N/A | N/A |
| 86 | 179 | GTAG | 69.21 | 110 | 80.15 | 134 | 70.28 | 77 | 88.42 | 233 | 72.97 | 106 | 62.48 | 69 | 63.71 | 99 | 50.09 | 34 |
| 87 | 126 | CTTC | 70.58 | 116 | 75.24 | 90 | 73.83 | 108 | 61.26 | 72 | 72.59 | 105 | 53.06 | 36 | 77.14 | 214 | 63.83 | 122 |
| 88 | 253 | TTTA | 78.85 | 182 | 79.98 | 132 | 71.25 | 90 | 63.10 | 88 | 67.09 | 63 | 73.29 | 118 | 54.50 | 35 | 67.89 | 156 |
| 89 | 19 | ACAG | 77.59 | 173 | 74.85 | 86 | 78.05 | 149 | 62.96 | 85 | 70.40 | 82 | 77.05 | 146 | 58.01 | 56 | 60.51 | 92 |
| 90 | 66 | CAAC | 66.52 | 90 | 75.24 | 91 | 90.63 | 196 | 60.15 | 65 | 68.83 | 70 | 68.56 | 87 | 73.52 | 189 | 59.47 | 82 |
| 91 | 25 | ACGA | 47.26 | 19 | 71.84 | 64 | 77.06 | 137 | 62.81 | 84 | 84.75 | 196 | N/A | N/A | 58.05 | 57 | 77.52 | 209 |
| 92 | 99 | CGAG | 62.90 | 70 | 79.03 | 127 | 70.55 | 80 | 79.84 | 212 | 73.07 | 108 | 80.31 | 169 | 55.55 | 40 | 57.60 | 71 |
| 93 | 106 | CGGC | 69.82 | 112 | 68.07 | 36 | 96.25 | 210 | 63.80 | 95 | 70.03 | 80 | 77.45 | 150 | 58.37 | 59 | 66.06 | 139 |
| 94 | 133 | GACA | 70.88 | 121 | 75.86 | 95 | 66.91 | 59 | 71.95 | 165 | 65.72 | 55 | N/A | N/A | 61.56 | 79 | 76.62 | 203 |
| 95 | 221 | TCTA | 54.90 | 32 | 64.80 | 25 | 128.91 | 226 | 66.73 | 123 | 70.82 | 85 | 66.86 | 78 | 66.22 | 129 | 75.29 | 194 |
| 96 | 201 | TAGA | 73.16 | 140 | 70.43 | 53 | 75.52 | 119 | 69.57 | 144 | 69.31 | 73 | 88.58 | 205 | 65.38 | 119 | 52.93 | 43 |
| 97 | 107 | CGGG | 78.98 | 183 | 64.60 | 24 | 74.68 | 114 | 51.58 | 35 | 86.06 | 204 | 79.33 | 163 | 62.89 | 91 | 60.78 | 94 |
| 98 | 139 | GAGG | 68.24 | 103 | 76.19 | 97 | 83.24 | 178 | 66.31 | 118 | 58.16 | 31 | N/A | N/A | 70.92 | 169 | 61.10 | 99 |
| 99 | 169 | GGGA | 73.64 | 142 | 96.71 | 237 | 93.34 | 204 | 39.69 | 17 | 77.89 | 152 | 60.45 | 64 | 53.90 | 33 | 57.22 | 68 |
| 100 | 52 | ATAT | 75.03 | 154 | 68.77 | 45 | 66.77 | 57 | 62.26 | 80 | 68.39 | 69 | 68.12 | 83 | 86.84 | 243 | 74.43 | 187 |
| 101 | 129 | GAAA | 77.60 | 174 | 74.43 | 80 | 70.19 | 76 | 58.73 | 57 | 90.36 | 218 | 59.82 | 62 | 72.41 | 185 | 58.50 | 76 |
| 102 | 224 | TCTT | 61.96 | 63 | 74.26 | 79 | 76.77 | 132 | 71.36 | 157 | 67.08 | 62 | 76.59 | 142 | 63.23 | 94 | 76.19 | 200 |
| 103 | 87 | CCCG | 57.14 | 39 | 72.04 | 66 | 70.63 | 81 | 59.20 | 60 | 75.84 | 133 | 108.76 | 223 | 75.22 | 202 | 64.94 | 130 |
| 104 | 144 | GATT | 82.90 | 214 | 85.93 | 179 | 61.35 | 37 | 65.23 | 106 | 71.51 | 95 | 48.53 | 23 | 64.44 | 111 | 70.04 | 169 |
| 105 | 81 | CCAA | 60.24 | 53 | 81.34 | 141 | 66.98 | 60 | 73.43 | 177 | 83.02 | 185 | 32.30 | 2 | 66.46 | 130 | 74.45 | 188 |
| 106 | 241 | TTAA | 72.94 | 138 | 70.48 | 54 | 76.35 | 129 | 71.63 | 162 | 69.62 | 77 | 69.68 | 92 | 72.05 | 181 | 62.28 | 108 |

Fig. 18A(4)

| | | | | | | | | | | | | | | | | |
|---|---|---|---|---|---|---|---|---|---|---|---|---|---|---|---|---|
| 107 | 100 | CGAT | 46.56 | 18 | 77.40 | 109 | 86.01 | 186 | 63.70 | 93 | 77.51 | 149 | 70.74 | 99 | 59.23 | 65 | 80.63 | 223 |
| 108 | 121 | CTGA | 44.48 | 14 | 95.99 | 235 | N/A | N/A | 59.19 | 59 | 87.65 | 211 | N/A | N/A | 62.57 | 86 | 61.75 | 104 |
| 109 | 64 | ATTT | 63.10 | 71 | 73.69 | 76 | 71.00 | 87 | 65.94 | 112 | 69.14 | 72 | 82.91 | 186 | 67.59 | 139 | 76.66 | 204 |
| 110 | 17 | ACAA | 89.62 | 238 | 78.08 | 116 | 74.84 | 117 | 63.95 | 96 | 70.74 | 84 | 60.39 | 63 | 63.63 | 96 | 66.99 | 145 |
| 111 | 189 | GTTA | 59.71 | 50 | 78.39 | 117 | 79.82 | 157 | 65.19 | 105 | 93.49 | 224 | 50.60 | 28 | 69.99 | 156 | 63.40 | 118 |
| 112 | 73 | CAGA | 64.95 | 83 | 83.20 | 153 | 67.48 | 64 | 67.89 | 130 | 75.69 | 130 | N/A | N/A | 64.18 | 107 | 71.02 | 173 |
| 113 | 70 | CACC | 77.50 | 169 | 70.23 | 52 | 93.28 | 203 | N/A | N/A | 66.61 | 57 | 97.69 | 215 | 58.76 | 61 | 59.99 | 86 |
| 114 | 218 | TCGC | 97.46 | 252 | 77.27 | 107 | 60.99 | 34 | 78.02 | 205 | N/A | N/A | 68.42 | 86 | 58.94 | 63 | 61.07 | 97 |
| 115 | 124 | CTGT | 70.70 | 117 | 84.59 | 172 | 71.31 | 92 | 64.69 | 101 | 76.75 | 141 | 66.15 | 77 | 67.51 | 136 | 65.74 | 134 |
| 116 | 101 | CGCA | 64.43 | 81 | 77.35 | 108 | 70.35 | 78 | 84.56 | 224 | 80.07 | 165 | 76.11 | 137 | 57.21 | 51 | 64.98 | 131 |
| 117 | 59 | ATGG | 79.34 | 186 | 138.30 | 254 | 57.31 | 27 | 59.53 | 62 | 94.28 | 226 | 36.05 | 5 | 65.84 | 125 | 60.87 | 95 |
| 118 | 184 | GTCT | 55.42 | 33 | 81.97 | 144 | 80.96 | 165 | 105.72 | 241 | N/A | N/A | 44.89 | 14 | 69.67 | 153 | 62.33 | 109 |
| 119 | 167 | GGCG | 71.79 | 130 | 72.81 | 73 | 81.64 | 169 | 84.48 | 222 | 71.87 | 98 | 72.24 | 109 | 64.25 | 108 | 59.66 | 83 |
| 120 | 191 | GTTG | 61.96 | 64 | 82.68 | 149 | 83.67 | 180 | 84.99 | 226 | 78.55 | 157 | 40.73 | 10 | 70.21 | 162 | 53.17 | 47 |
| 121 | 222 | TCTC | 56.59 | 37 | 73.49 | 75 | N/A | N/A | 88.12 | 232 | 74.72 | 121 | 69.89 | 95 | 67.43 | 135 | 71.74 | 177 |
| 122 | 28 | ACGT | 62.71 | 68 | 68.36 | 40 | 71.00 | 88 | 63.29 | 90 | 110.06 | 236 | 71.53 | 104 | 80.50 | 225 | 67.45 | 150 |
| 123 | 249 | TTGA | 56.92 | 38 | 71.87 | 65 | 82.61 | 175 | N/A | N/A | 87.81 | 212 | 77.68 | 153 | 65.36 | 118 | 63.20 | 116 |
| 124 | 177 | GTAA | 74.68 | 152 | 76.05 | 96 | 82.21 | 171 | 67.64 | 128 | 87.60 | 209 | 69.79 | 93 | 63.18 | 93 | 57.09 | 65 |
| 125 | 80 | CATT | 53.28 | 30 | 85.96 | 180 | 76.72 | 130 | 65.92 | 111 | 75.23 | 125 | 72.55 | 115 | 70.13 | 160 | 69.02 | 166 |
| 126 | 187 | GTGG | 49.60 | 21 | 98.27 | 242 | 108.71 | 219 | 74.66 | 184 | 73.09 | 110 | 54.24 | 43 | 67.14 | 131 | 58.25 | 73 |
| 127 | 245 | TTCA | 57.49 | 42 | 84.27 | 170 | 79.74 | 156 | 33.20 | 6 | 82.51 | 182 | 70.50 | 97 | 68.34 | 142 | 84.81 | 231 |
| 128 | 62 | ATTC | 77.57 | 172 | 82.26 | 146 | 70.69 | 83 | 59.98 | 63 | 77.00 | 144 | 50.17 | 27 | 71.98 | 178 | 80.17 | 221 |
| 129 | 165 | GGCA | 60.85 | 60 | 85.87 | 177 | 77.38 | 141 | 50.70 | 32 | 95.68 | 230 | 65.20 | 75 | 78.36 | 218 | 61.68 | 102 |
| 130 | 203 | TAGG | 83.46 | 218 | 63.09 | 21 | 75.82 | 121 | 71.34 | 155 | 71.94 | 99 | 71.05 | 101 | 64.32 | 109 | 78.89 | 216 |
| 131 | 199 | TACG | 80.64 | 197 | 71.25 | 59 | 68.65 | 70 | 66.59 | 120 | 103.91 | 234 | 59.12 | 59 | 107.68 | 248 | 55.14 | 54 |
| 132 | 50 | ATAC | 79.80 | 191 | 84.11 | 166 | 66.98 | 61 | 79.99 | 215 | 80.63 | 170 | 55.61 | 46 | 62.89 | 90 | 61.75 | 103 |
| 133 | 246 | TTCC | 73.71 | 143 | 78.62 | 121 | 82.12 | 170 | 79.89 | 213 | 77.01 | 145 | 71.50 | 103 | 48.57 | 23 | 64.70 | 128 |
| 134 | 130 | GAAC | 72.36 | 132 | 83.69 | 160 | 124.36 | 225 | 71.56 | 161 | 67.35 | 64 | 73.07 | 116 | 64.67 | 115 | 58.40 | 74 |

Fig. 18A(5)

| | | | | | | | | | | | | | | |
|---|---|---|---|---|---|---|---|---|---|---|---|---|---|---|
| 135 | 33 | AGAA | 70.76 | 118 | 70.89 | 56 | 77.15 | 138 | 42.19 | 19 | 81.86 | 177 | 91.67 | 209 | 84.34 | 233 | 61.18 | 100 |
| 136 | 114 | CTAC | 70.20 | 114 | 77.21 | 106 | N/A | N/A | 71.81 | 164 | 72.23 | 101 | 71.39 | 102 | 73.41 | 188 | 66.85 | 144 |
| 137 | 32 | ACTT | 71.10 | 125 | 76.57 | 99 | 75.96 | 123 | 72.19 | 167 | 74.96 | 123 | 65.31 | 76 | 72.31 | 183 | 67.96 | 157 |
| 138 | 137 | GAGA | 67.88 | 101 | 90.21 | 214 | 68.49 | 69 | 27.69 | 1 | 59.49 | 37 | 101.67 | 218 | 70.28 | 164 | 116.99 | 249 |
| 139 | 110 | CGTC | 75.37 | 158 | 90.14 | 211 | 60.78 | 32 | 64.62 | 99 | 76.01 | 135 | 72.24 | 110 | 70.41 | 167 | 66.33 | 142 |
| 140 | 205 | TATA | 76.38 | 165 | 78.80 | 125 | 64.00 | 48 | 68.41 | 133 | 78.22 | 155 | 81.07 | 175 | N/A | N/A | 65.13 | 132 |
| 141 | 219 | TCGG | 75.75 | 162 | 78.79 | 124 | 64.00 | 144 | 85.57 | 228 | 80.79 | 172 | 61.80 | 66 | 64.05 | 106 | 58.22 | 72 |
| 142 | 54 | ATCC | 87.49 | 233 | 85.52 | 175 | N/A | N/A | 55.49 | 50 | 84.75 | 197 | 69.39 | 90 | 62.58 | 88 | 62.26 | 107 |
| 143 | 3 | AAAG | 74.56 | 151 | 139.01 | 255 | 71.76 | 95 | 72.23 | 168 | 69.81 | 78 | 76.46 | 141 | 65.79 | 124 | 56.63 | 63 |
| 144 | 252 | TTGT | 74.55 | 150 | 90.30 | 215 | 75.85 | 122 | 65.62 | 109 | N/A | N/A | 75.12 | 129 | 59.40 | 66 | 67.54 | 152 |
| 145 | 46 | AGTC | 72.75 | 136 | 81.56 | 143 | 80.26 | 161 | 65.45 | 108 | 71.20 | 87 | 87.74 | 204 | 65.73 | 123 | 64.30 | 125 |
| 146 | 168 | GGCT | 74.25 | 147 | 81.52 | 142 | 50.55 | 11 | 73.26 | 175 | 73.86 | 117 | 67.19 | 79 | 80.70 | 226 | 75.37 | 195 |
| 147 | 208 | TATT | 88.36 | 236 | 73.98 | 78 | 70.11 | 75 | 65.10 | 104 | 73.70 | 115 | 81.39 | 179 | 69.39 | 151 | 67.87 | 155 |
| 148 | 185 | GTGA | 59.16 | 45 | 94.17 | 228 | 83.61 | 179 | 51.86 | 37 | 114.85 | 238 | 56.26 | 50 | 68.56 | 147 | 70.16 | 170 |
| 149 | 95 | CCTG | 60.41 | 56 | 72.75 | 71 | 79.13 | 154 | 66.06 | 115 | N/A | N/A | 86.62 | 199 | 86.12 | 239 | 64.49 | 127 |
| 150 | 89 | CCGA | 33.81 | 2 | 83.89 | 163 | N/A | N/A | 77.77 | 204 | 64.97 | 52 | 71.83 | 105 | 74.05 | 193 | 95.06 | 244 |
| 151 | 242 | TTAC | 71.05 | 123 | 68.46 | 42 | 76.73 | 131 | 74.29 | 182 | 77.10 | 146 | 78.77 | 158 | 67.56 | 138 | 73.88 | 186 |
| 152 | 49 | ATAA | 90.67 | 243 | 75.72 | 92 | 72.47 | 100 | 78.06 | 206 | 78.40 | 156 | N/A | N/A | 64.56 | 114 | 56.07 | 60 |
| 153 | 11 | AAGG | 77.83 | 175 | 67.92 | 35 | 74.69 | 115 | 72.74 | 172 | 87.62 | 210 | 80.45 | 170 | 61.13 | 76 | 68.56 | 163 |
| 154 | 9 | AAGA | 79.67 | 190 | 87.30 | 189 | 70.90 | 86 | 71.17 | 152 | 76.63 | 139 | 98.05 | 216 | 63.03 | 92 | 55.16 | 56 |
| 155 | 63 | ATTG | 67.08 | 95 | 93.18 | 223 | 72.20 | 98 | 64.04 | 97 | 74.11 | 118 | 83.70 | 187 | 68.98 | 148 | 68.14 | 158 |
| 156 | 105 | CGGA | 82.96 | 215 | 72.33 | 68 | 72.83 | 103 | 74.96 | 186 | 88.16 | 214 | N/A | N/A | 58.40 | 60 | 66.05 | 138 |
| 157 | 192 | GTTT | 63.61 | 74 | 98.11 | 241 | 139.09 | 228 | 63.49 | 91 | 125.14 | 240 | 56.74 | 53 | 62.74 | 89 | 62.54 | 110 |
| 158 | 207 | TATG | 79.23 | 185 | 90.15 | 212 | 59.59 | 30 | 74.94 | 185 | 74.35 | 119 | 74.77 | 126 | 68.54 | 146 | 64.20 | 124 |
| 159 | 51 | ATAG | 93.62 | 249 | 87.02 | 185 | 65.34 | 52 | 68.45 | 134 | 75.90 | 134 | 102.67 | 220 | 65.02 | 117 | 50.60 | 37 |
| 160 | 135 | GACG | 75.37 | 157 | 78.50 | 119 | 82.57 | 174 | 61.50 | 73 | 76.79 | 142 | 86.71 | 201 | 69.99 | 157 | 61.89 | 105 |
| 161 | 209 | TCAA | 80.79 | 198 | 81.32 | 140 | 60.93 | 33 | 76.22 | 193 | 70.48 | 83 | 75.34 | 131 | 69.32 | 150 | 76.40 | 201 |

Fig. 18A(6)

| | | | | | | | | | | | | | | | | | | |
|---|---|---|---|---|---|---|---|---|---|---|---|---|---|---|---|---|---|---|
| 162 | 20 | ACAT | 90.38 | 241 | 88.41 | 196 | 69.38 | 72 | 70.27 | 145 | 71.98 | 100 | 74.35 | 125 | 66.20 | 128 | 64.05 | 123 |
| 163 | 230 | TGCC | 63.40 | 73 | 73.36 | 74 | 84.01 | 182 | N/A | N/A | N/A | N/A | N/A | N/A | N/A | N/A | 87.55 | 236 |
| 164 | 22 | ACCC | 69.83 | 113 | 84.20 | 167 | 360.73 | 232 | 40.14 | 18 | 67.00 | 60 | 81.62 | 183 | 70.05 | 158 | 76.84 | 205 |
| 165 | 104 | CGCT | 82.57 | 212 | 74.62 | 82 | 94.87 | 207 | 72.49 | 171 | 78.21 | 154 | 73.70 | 121 | 62.50 | 85 | 63.06 | 114 |
| 166 | 197 | TACA | 80.55 | 195 | 88.11 | 195 | 64.01 | 49 | 84.73 | 225 | 65.51 | 53 | 76.00 | 136 | 65.44 | 121 | 71.63 | 175 |
| 167 | 6 | AACC | 80.18 | 192 | 93.97 | 225 | N/A | N/A | 71.52 | 160 | 72.97 | 107 | N/A | N/A | 63.67 | 97 | 59.42 | 81 |
| 168 | 183 | GTCG | 53.05 | 29 | 79.84 | 131 | 95.24 | 208 | 69.04 | 139 | 90.32 | 217 | 70.64 | 98 | 70.07 | 159 | 70.96 | 172 |
| 169 | 65 | CAAA | 62.52 | 66 | 78.65 | 123 | 82.95 | 176 | 71.47 | 159 | 73.47 | 112 | 77.24 | 147 | 71.90 | 177 | 75.43 | 196 |
| 170 | 53 | ATCA | 77.99 | 177 | 89.12 | 203 | 73.53 | 106 | 62.74 | 83 | 76.35 | 136 | 72.15 | 108 | 65.43 | 120 | 84.40 | 230 |
| 171 | 67 | CAAG | 72.17 | 131 | 107.82 | 249 | 76.00 | 125 | 66.06 | 114 | 71.31 | 90 | N/A | N/A | 69.88 | 155 | 67.72 | 154 |
| 172 | 206 | TATC | 77.57 | 171 | 89.46 | 206 | 62.84 | 44 | 75.93 | 189 | 60.27 | 40 | 76.34 | 139 | 76.75 | 210 | 69.56 | 167 |
| 173 | 36 | AGAT | 80.96 | 201 | 75.78 | 94 | 53.13 | 17 | 70.42 | 147 | 76.36 | 137 | 83.92 | 188 | 74.06 | 195 | 74.52 | 189 |
| 174 | 103 | CGCG | 125.02 | 255 | 72.32 | 67 | 80.36 | 162 | 67.56 | 127 | 97.53 | 231 | N/A | N/A | 63.89 | 101 | 59.86 | 84 |
| 175 | 128 | CTTT | 72.98 | 139 | 87.83 | 193 | 72.04 | 96 | 58.86 | 58 | 89.18 | 216 | 72.37 | 112 | 83.53 | 231 | 65.66 | 133 |
| 176 | 200 | TACT | 87.43 | 232 | 65.63 | 26 | 67.96 | 66 | 79.20 | 209 | 80.78 | 171 | 80.56 | 172 | 74.16 | 196 | 61.91 | 106 |
| 177 | 220 | TCGT | 87.10 | 230 | 79.06 | 128 | 83.88 | 181 | 66.97 | 125 | 72.39 | 102 | 79.15 | 162 | 64.48 | 112 | N/A | N/A |
| 178 | 211 | TCAG | 81.49 | 204 | 90.60 | 217 | 79.92 | 158 | 66.02 | 113 | 75.78 | 132 | 74.83 | 128 | 67.31 | 134 | 62.85 | 112 |
| 179 | 223 | TCTG | 72.42 | 135 | 95.29 | 230 | 91.12 | 198 | 74.14 | 181 | 69.37 | 74 | 75.15 | 130 | 63.92 | 103 | 67.58 | 153 |
| 180 | 16 | AATT | 84.54 | 220 | 69.46 | 48 | 78.00 | 148 | 66.60 | 121 | 77.27 | 147 | 74.02 | 124 | 75.56 | 204 | 77.01 | 207 |
| 181 | 111 | CGTG | 75.03 | 155 | 82.01 | 145 | 68.12 | 68 | 68.50 | 135 | 79.35 | 162 | 73.27 | 117 | 73.68 | 191 | 99.19 | 246 |
| 182 | 125 | CTTA | 70.81 | 119 | 81.09 | 139 | 73.96 | 109 | 67.71 | 129 | N/A | N/A | N/A | N/A | 71.71 | 176 | 99.86 | 247 |
| 183 | 60 | ATGT | 80.44 | 194 | 84.45 | 171 | 44.43 | 4 | 70.75 | 150 | 82.79 | 183 | 75.41 | 132 | 90.44 | 247 | 67.00 | 146 |
| 184 | 210 | TCAC | 63.73 | 77 | 76.53 | 98 | 79.92 | 159 | 36.31 | 12 | 104.55 | 235 | 92.68 | 212 | 78.24 | 217 | 78.90 | 217 |
| 185 | 141 | GATA | 95.02 | 250 | 74.84 | 85 | 91.21 | 199 | N/A | N/A | 74.53 | 120 | 73.29 | 119 | 76.49 | 208 | 60.61 | 93 |
| 186 | 34 | AGAC | 78.50 | 180 | 79.13 | 129 | 101.67 | 215 | 71.63 | 163 | 71.47 | 94 | 79.05 | 161 | 67.18 | 132 | 68.46 | 160 |
| 187 | 204 | TAGT | 91.18 | 245 | 84.25 | 169 | 92.03 | 201 | 72.26 | 169 | 66.86 | 59 | 69.40 | 91 | 68.99 | 149 | 68.61 | 165 |
| 188 | 181 | GTCA | 114.04 | 254 | 83.39 | 155 | 100.90 | 214 | 61.90 | 76 | 84.12 | 190 | 74.78 | 127 | 62.57 | 87 | 67.42 | 149 |

Fig. 18A(7)

| | | | | | | | | | | | | | | |
|---|---|---|---|---|---|---|---|---|---|---|---|---|---|---|
| 189 | 142 | GATC | 72.41 | 133 | 89.04 | 202 | 87.57 | 192 | 70.76 | 151 | 75.33 | 126 | 86.29 | 197 | 70.13 | 161 | 60.39 | 91 |
| 190 | 116 | CTAT | 80.41 | 193 | 96.23 | 236 | 77.22 | 139 | N/A | N/A | 70.87 | 86 | 76.94 | 145 | 71.01 | 172 | 64.33 | 126 |
| 191 | 42 | AGGC | 72.91 | 137 | 81.02 | 137 | N/A | N/A | 79.09 | 208 | 87.53 | 208 | 57.36 | 56 | 85.93 | 238 | 63.20 | 115 |
| 192 | 1 | AAAA | 87.21 | 231 | 78.63 | 122 | 77.71 | 143 | 68.37 | 132 | 87.37 | 205 | N/A | N/A | 66.09 | 127 | 66.30 | 141 |
| 193 | 134 | GACC | 77.53 | 170 | 67.89 | 34 | 148.56 | 229 | 69.47 | 143 | 83.83 | 189 | 77.31 | 149 | 70.25 | 163 | 72.45 | 182 |
| 194 | 254 | TTTC | 80.58 | 196 | 89.83 | 209 | N/A | N/A | 66.43 | 119 | 76.70 | 140 | 80.53 | 171 | 63.79 | 100 | 70.39 | 171 |
| 195 | 117 | CTCA | 86.48 | 228 | 83.86 | 162 | 76.84 | 134 | 64.64 | 100 | 98.87 | 232 | 81.15 | 176 | 68.49 | 145 | 61.01 | 96 |
| 196 | 136 | GACT | 80.80 | 199 | 125.62 | 253 | 75.66 | 120 | 72.33 | 170 | 80.16 | 166 | 70.97 | 100 | 73.65 | 190 | 58.85 | 77 |
| 197 | 115 | CTAG | 75.57 | 161 | 103.17 | 248 | 77.36 | 140 | 69.02 | 138 | N/A | N/A | N/A | N/A | 67.27 | 133 | 66.00 | 137 |
| 198 | 72 | CACT | 75.54 | 159 | 84.94 | 174 | N/A | N/A | 75.76 | 188 | 75.12 | 124 | N/A | N/A | 61.70 | 82 | 85.85 | 232 |
| 199 | 15 | AATG | 90.31 | 240 | 91.51 | 219 | 70.79 | 84 | 71.42 | 158 | 76.96 | 143 | 78.95 | 160 | 68.18 | 141 | 65.78 | 135 |
| 200 | 143 | GATG | 82.18 | 209 | 77.08 | 104 | 82.35 | 172 | 75.16 | 187 | N/A | N/A | 56.13 | 49 | 70.94 | 170 | 83.55 | 229 |
| 201 | 61 | ATTA | 86.48 | 227 | 87.73 | 191 | 75.97 | 124 | 71.18 | 153 | 73.55 | 113 | N/A | N/A | 60.48 | 72 | 91.80 | 241 |
| 202 | 35 | AGAG | 80.89 | 200 | 68.45 | 41 | 87.40 | 191 | 64.52 | 98 | 80.52 | 168 | 81.53 | 182 | 75.82 | 206 | 78.70 | 214 |
| 203 | 85 | CCCA | 88.24 | 235 | 85.91 | 178 | 81.43 | 167 | 58.51 | 55 | 73.63 | 114 | N/A | N/A | 72.00 | 180 | 78.82 | 215 |
| 204 | 68 | CAAT | 70.31 | 115 | 90.37 | 216 | 80.88 | 164 | 71.31 | 154 | 77.69 | 150 | 81.51 | 181 | 71.16 | 173 | 68.53 | 161 |
| 205 | 14 | AATC | 90.09 | 239 | 89.40 | 205 | 68.88 | 71 | 70.66 | 148 | 81.08 | 174 | 78.27 | 157 | 72.36 | 184 | 66.14 | 140 |
| 206 | 248 | TTCT | 67.84 | 100 | 68.10 | 38 | 90.96 | 197 | N/A | N/A | 84.50 | 192 | 84.60 | 190 | 109.00 | 249 | 74.60 | 190 |
| 207 | 182 | GTCC | 76.24 | 164 | 69.74 | 50 | 132.12 | 227 | 64.83 | 102 | 84.98 | 198 | 86.52 | 198 | 75.68 | 205 | 75.46 | 198 |
| 208 | 13 | AATA | 93.48 | 248 | 82.69 | 150 | 84.97 | 184 | 66.82 | 124 | 84.59 | 193 | N/A | N/A | 63.92 | 104 | 72.93 | 184 |
| 209 | 86 | CCCC | 65.16 | 84 | 93.13 | 222 | 117.51 | 222 | 77.01 | 197 | 80.61 | 169 | 64.99 | 74 | 73.22 | 187 | 76.55 | 202 |
| 210 | 55 | ATCG | 88.83 | 237 | 82.62 | 148 | 121.85 | 224 | 70.70 | 149 | 80.06 | 164 | N/A | N/A | 65.49 | 122 | 67.16 | 148 |
| 211 | 109 | CGTA | 74.47 | 148 | 222.74 | 256 | 65.82 | 53 | 76.48 | 194 | 92.66 | 221 | N/A | N/A | 68.45 | 143 | 71.90 | 178 |
| 212 | 227 | TGAG | 62.76 | 69 | 93.96 | 224 | 73.79 | 107 | 77.12 | 200 | 86.01 | 203 | 85.01 | 193 | 73.72 | 192 | 71.94 | 181 |
| 213 | 127 | CTTG | 67.24 | 96 | 95.73 | 232 | 77.04 | 136 | 76.63 | 195 | 80.43 | 167 | N/A | N/A | 77.03 | 213 | 68.53 | 162 |
| 214 | 56 | ATCT | 79.60 | 188 | 98.81 | 243 | 97.66 | 212 | 95.73 | 238 | 75.40 | 127 | 76.35 | 140 | 67.91 | 140 | 60.20 | 89 |

Fig. 18A(8)

| | | | | | | | | | | | | | | |
|---|---|---|---|---|---|---|---|---|---|---|---|---|---|---|
| 215 | 8 | AACT | 63.39 | 72 | 89.56 | 208 | 78.72 | 152 | 133.37 | 243 | N/A | N/A | 82.01 | 184 | 71.98 | 179 | 71.48 | 174 |
| 216 | 39 | AGCG | 55.62 | 34 | 81.03 | 138 | 90.52 | 195 | N/A | N/A | 94.55 | 227 | 98.66 | 217 | 78.60 | 219 | 73.52 | 185 |
| 217 | 217 | TCGA | 74.55 | 149 | 87.65 | 190 | 70.63 | 82 | 80.91 | 218 | 87.39 | 206 | 76.72 | 143 | 74.91 | 201 | 78.18 | 210 |
| 218 | 113 | CTAA | 81.74 | 207 | 82.35 | 147 | 74.43 | 113 | 73.65 | 179 | 79.49 | 163 | 116.48 | 225 | 68.47 | 144 | 81.07 | 224 |
| 219 | 237 | TGTA | 78.22 | 178 | 74.76 | 84 | 120.76 | 223 | 80.70 | 217 | 71.33 | 91 | 79.83 | 167 | 80.22 | 224 | 80.00 | 220 |
| 220 | 225 | TGAA | 81.19 | 202 | 83.42 | 157 | 84.02 | 183 | 85.37 | 227 | 77.75 | 151 | 69.80 | 94 | 76.65 | 209 | 72.75 | 183 |
| 221 | 69 | CACA | 78.67 | 181 | 91.38 | 218 | 74.72 | 116 | 69.10 | 141 | 82.23 | 180 | 85.55 | 194 | 75.46 | 203 | N/A | N/A |
| 222 | 112 | CGTT | 76.02 | 163 | 92.06 | 220 | 78.20 | 150 | 77.13 | 201 | 85.76 | 201 | 69.94 | 96 | 77.00 | 212 | N/A | N/A |
| 223 | 88 | CCCT | 64.56 | 82 | 83.70 | 161 | 72.52 | 102 | 89.96 | 234 | 82.17 | 178 | 92.41 | 211 | 132.23 | 251 | 76.87 | 206 |
| 224 | 23 | ACCG | 92.45 | 247 | 79.82 | 130 | 83.22 | 177 | 72.11 | 166 | 79.16 | 160 | 75.57 | 133 | 72.05 | 182 | 86.09 | 233 |
| 225 | 2 | AAAC | 86.91 | 229 | 86.72 | 183 | 77.79 | 145 | 76.12 | 192 | 85.50 | 200 | 81.04 | 174 | 70.95 | 171 | 65.85 | 136 |
| 226 | 212 | TCAT | 82.25 | 210 | 100.54 | 244 | 74.42 | 112 | 81.54 | 219 | 79.31 | 161 | 85.85 | 195 | 64.89 | 116 | 71.69 | 176 |
| 227 | 5 | AACA | 82.03 | 208 | 102.03 | 246 | 76.87 | 135 | 71.35 | 156 | 71.29 | 89 | 95.87 | 214 | N/A | N/A | 77.15 | 208 |
| 228 | 47 | AGTG | 68.89 | 107 | 83.05 | 152 | 89.02 | 194 | 78.89 | 207 | 82.81 | 184 | 81.22 | 177 | 83.88 | 232 | 75.15 | 192 |
| 229 | 214 | TCCC | 88.19 | 234 | 77.05 | 103 | 78.22 | 151 | 76.96 | 196 | 75.69 | 131 | N/A | N/A | 89.31 | 246 | 78.25 | 212 |
| 230 | 215 | TCCG | 90.57 | 242 | 80.30 | 135 | 82.42 | 173 | 73.62 | 178 | 76.58 | 138 | 89.79 | 207 | 80.86 | 227 | 68.31 | 159 |
| 231 | 38 | AGCC | 86.33 | 226 | 77.43 | 110 | 87.33 | 189 | 80.43 | 216 | 83.60 | 188 | 78.21 | 156 | 77.19 | 215 | 69.96 | 168 |
| 232 | 234 | TGGC | 64.41 | 80 | 88.50 | 198 | N/A | N/A | 72.86 | 173 | 82.32 | 181 | 84.96 | 192 | 86.57 | 241 | 80.18 | 222 |
| 233 | 45 | AGTA | 71.40 | 128 | 77.89 | 115 | 81.38 | 166 | 77.24 | 202 | 88.91 | 215 | 104.60 | 222 | 84.62 | 234 | 78.19 | 211 |
| 234 | 228 | TGAT | 85.64 | 223 | 87.88 | 194 | 76.05 | 126 | 79.93 | 214 | N/A | N/A | 78.86 | 159 | 70.36 | 166 | 91.45 | 239 |
| 235 | 213 | TCCA | 91.13 | 244 | 101.29 | 245 | 61.15 | 35 | 79.36 | 210 | N/A | N/A | 85.98 | 196 | 74.48 | 199 | 75.26 | 193 |
| 236 | 108 | CGGT | 83.16 | 217 | 90.19 | 213 | 73.16 | 105 | 104.86 | 240 | 93.95 | 225 | 79.38 | 164 | 70.58 | 168 | 75.10 | 191 |

Fig. 18A(9)

| | | | | | | | | | | | |
|---|---|---|---|---|---|---|---|---|---|---|---|
| 237 | 229 | TGCA | 71.23 | 127 | 87.23 | 187 | 79.15 | 155 | 87.74 | 231 | 87.87 | 213 | 77.48 | 151 | 86.70 | 242 | 79.41 | 218 |
| 238 | 37 | AGCA | 83.10 | 216 | 85.57 | 176 | 87.39 | 190 | 66.12 | 116 | 90.83 | 220 | N/A | N/A | 74.37 | 197 | 79.91 | 219 |
| 239 | 239 | TGTG | 76.41 | 166 | 94.15 | 227 | N/A | N/A | 77.07 | 199 | 77.32 | 148 | 110.58 | 224 | 84.72 | 235 | 67.09 | 147 |
| 240 | 231 | TGCG | 74.69 | 153 | 86.37 | 182 | 87.30 | 188 | 91.97 | 237 | 80.94 | 173 | 80.57 | 173 | 78.96 | 221 | 78.64 | 213 |
| 241 | 226 | TGAC | 84.64 | 221 | 89.18 | 204 | 106.84 | 218 | 76.03 | 191 | 94.57 | 228 | 73.50 | 120 | 76.82 | 211 | 67.50 | 151 |
| 242 | 236 | TGGT | 79.11 | 184 | 76.66 | 100 | 97.31 | 211 | N/A | N/A | 81.30 | 175 | 102.37 | 219 | 82.29 | 229 | 87.08 | 235 |
| 243 | 232 | TGCT | 57.69 | 43 | 95.24 | 229 | 91.54 | 200 | 82.10 | 221 | 84.29 | 191 | 91.86 | 210 | 83.35 | 230 | 83.14 | 227 |
| 244 | 24 | ACCT | 96.57 | 251 | 84.93 | 173 | 76.14 | 127 | 73.03 | 174 | 90.46 | 219 | 84.26 | 189 | 74.46 | 198 | 87.02 | 234 |
| 245 | 41 | AGGA | 81.23 | 203 | 93.99 | 226 | 77.53 | 142 | 91.66 | 236 | 93.02 | 223 | 68.22 | 84 | 113.69 | 250 | 90.63 | 238 |
| 246 | 44 | AGGT | 83.59 | 219 | 80.67 | 136 | 94.43 | 206 | 65.83 | 110 | 95.29 | 229 | 104.27 | 221 | 86.47 | 240 | 92.25 | 242 |
| 247 | 43 | AGGG | 86.24 | 225 | 97.24 | 239 | N/A | N/A | 66.15 | 117 | 87.41 | 207 | 77.87 | 154 | 79.81 | 223 | 91.72 | 240 |
| 248 | 21 | ACCA | 135.86 | 256 | 97.64 | 240 | 74.90 | 118 | 76.00 | 190 | 84.70 | 195 | 86.68 | 200 | 80.99 | 228 | 71.92 | 180 |
| 249 | 233 | TGGA | 71.07 | 124 | 110.33 | 252 | 92.16 | 202 | 79.48 | 211 | N/A | N/A | 77.27 | 148 | 87.17 | 244 | 82.74 | 226 |
| 250 | 40 | AGCT | 67.69 | 99 | 87.27 | 188 | 95.79 | 209 | 86.79 | 229 | 102.52 | 233 | 93.53 | 213 | 89.04 | 245 | 75.44 | 197 |
| 251 | 12 | AAGT | 81.66 | 205 | 92.86 | 221 | 74.22 | 111 | 107.95 | 242 | N/A | N/A | 89.87 | 208 | 71.18 | 175 | 118.83 | 250 |
| 252 | 48 | AGTT | 82.33 | 211 | 96.83 | 238 | 87.79 | 193 | 74.41 | 183 | 83.59 | 187 | 81.39 | 178 | 78.87 | 220 | 81.71 | 225 |
| 253 | 235 | TGGG | 75.55 | 160 | 88.44 | 197 | 98.72 | 213 | 96.03 | 239 | 85.88 | 202 | 84.86 | 191 | 85.53 | 237 | 88.22 | 237 |
| 254 | 238 | TGTC | 85.93 | 224 | 88.81 | 199 | 78.81 | 153 | 77.37 | 203 | 118.62 | 239 | N/A | N/A | 77.66 | 216 | 103.38 | 248 |
| 255 | 216 | TCCT | 100.46 | 253 | 95.84 | 234 | 72.52 | 101 | 91.36 | 235 | 92.72 | 222 | 88.88 | 206 | 76.37 | 207 | 94.84 | 243 |
| 256 | 240 | TGTT | 82.60 | 213 | 110.20 | 251 | 77.91 | 147 | 86.95 | 230 | 84.66 | 194 | 87.10 | 202 | 85.39 | 236 | 95.58 | 245 |

Fig. 18A(10)

| Average %bound | Average Rank | Rank Order | oligo |
|---|---|---|---|
| 41.60 | 13 | 1 | 155 |
| 44.83 | 14 | 2 | 153 |
| 47.90 | 19 | 3 | 145 |
| 45.95 | 20 | 4 | 156 |
| 48.40 | 21 | 5 | 151 |
| 50.98 | 23 | 6 | 75 |
| 50.44 | 24 | 7 | 146 |
| 46.98 | 24 | 8 | 148 |
| 51.15 | 25 | 9 | 149 |
| 50.03 | 30 | 10 | 123 |
| 52.31 | 30 | 11 | 150 |
| 50.74 | 31 | 12 | 159 |
| 52.62 | 31 | 13 | 171 |
| 54.33 | 32 | 14 | 170 |
| 52.55 | 33 | 15 | 90 |
| 48.68 | 33 | 16 | 147 |
| 53.34 | 35 | 17 | 160 |
| 52.83 | 36 | 18 | 152 |
| 56.44 | 37 | 19 | 161 |
| 55.41 | 38 | 20 | 157 |
| 56.60 | 39 | 21 | 84 |
| 49.76 | 40 | 22 | 122 |
| 56.92 | 44 | 23 | 158 |
| 59.58 | 47 | 24 | 162 |
| 56.88 | 48 | 25 | 194 |
| 51.95 | 48 | 26 | 154 |
| 58.29 | 48 | 27 | 164 |
| 59.04 | 50 | 28 | 174 |
| 60.82 | 54 | 29 | 163 |
| 57.05 | 55 | 30 | 119 |
| 58.39 | 55 | 31 | 120 |
| 58.16 | 56 | 32 | 176 |
| 57.22 | 60 | 33 | 92 |
| 61.10 | 60 | 34 | 74 |
| 65.43 | 61 | 35 | 118 |
| 63.21 | 61 | 36 | 195 |
| 57.54 | 61 | 37 | 172 |
| 58.02 | 61 | 38 | 97 |
| 61.28 | 63 | 39 | 78 |
| 60.34 | 71 | 40 | 173 |
| 62.43 | 72 | 41 | 190 |
| 63.21 | 72 | 42 | 26 |
| 63.28 | 73 | 43 | 94 |
| 62.42 | 75 | 44 | 193 |
| 62.16 | 76 | 45 | 98 |
| 60.14 | 77 | 46 | 91 |
| 66.49 | 78 | 47 | 243 |
| 62.57 | 82 | 48 | 166 |
| 64.66 | 83 | 49 | 244 |
| 65.83 | 83 | 50 | 196 |
| 62.85 | 84 | 51 | 82 |
| 63.56 | 84 | 52 | 138 |
| 65.76 | 85 | 53 | 71 |
| 62.04 | 85 | 54 | 202 |
| 63.01 | 86 | 55 | 250 |
| 63.08 | 86 | 56 | 27 |
| 63.70 | 86 | 57 | 57 |
| 63.20 | 87 | 58 | 132 |
| 65.71 | 89 | 59 | 251 |
| 63.58 | 89 | 60 | 186 |
| 65.46 | 90 | 61 | 180 |
| 66.20 | 91 | 62 | 30 |
| 68.33 | 95 | 63 | 4 |
| 67.17 | 97 | 64 | 140 |
| 70.95 | 98 | 65 | 31 |
| 68.57 | 98 | 66 | 178 |

| | | | | | | | |
|---|---|---|---|---|---|---|---|
| 68.42 | 99 | 67 | 175 | 70.26 | 116 | 101 | 129 |
| 67.28 | 99 | 68 | 7 | 70.93 | 116 | 102 | 224 |
| 66.75 | 100 | 69 | 79 | 72.97 | 117 | 103 | 87 |
| 68.77 | 100 | 70 | 255 | 68.74 | 117 | 104 | 144 |
| 67.62 | 100 | 71 | 29 | 67.28 | 117 | 105 | 81 |
| 68.21 | 101 | 72 | 256 | 70.63 | 118 | 106 | 241 |
| 66.79 | 101 | 73 | 77 | 70.22 | 118 | 107 | 100 |
| 63.46 | 101 | 74 | 83 | 68.61 | 118 | 108 | 121 |
| 77.04 | 102 | 75 | 247 | 71.25 | 118 | 109 | 64 |
| 68.28 | 103 | 76 | 76 | 71.03 | 119 | 110 | 17 |
| 65.53 | 103 | 77 | 93 | 70.07 | 119 | 111 | 189 |
| 69.32 | 105 | 78 | 18 | 70.63 | 120 | 112 | 73 |
| 67.05 | 105 | 79 | 96 | 74.87 | 120 | 113 | 70 |
| 68.28 | 105 | 80 | 198 | 71.74 | 121 | 114 | 218 |
| 68.56 | 105 | 81 | 188 | 70.93 | 121 | 115 | 124 |
| 77.99 | 106 | 82 | 131 | 71.88 | 122 | 116 | 101 |
| 68.93 | 107 | 83 | 58 | 73.94 | 123 | 117 | 59 |
| 65.48 | 107 | 84 | 10 | 71.57 | 123 | 118 | 184 |
| 69.82 | 107 | 85 | 102 | 72.34 | 124 | 119 | 167 |
| 69.66 | 108 | 86 | 179 | 69.49 | 124 | 120 | 191 |
| 68.44 | 108 | 87 | 126 | 71.71 | 125 | 121 | 222 |
| 69.49 | 108 | 88 | 253 | 74.36 | 125 | 122 | 28 |
| 69.93 | 109 | 89 | 19 | 72.21 | 125 | 123 | 249 |
| 70.36 | 109 | 90 | 66 | 72.28 | 126 | 124 | 177 |
| 68.47 | 109 | 91 | 25 | 71.10 | 127 | 125 | 80 |
| 69.86 | 110 | 92 | 99 | 73.00 | 128 | 126 | 187 |
| 71.23 | 110 | 93 | 106 | 70.11 | 128 | 127 | 245 |
| 69.93 | 111 | 94 | 133 | 71.23 | 129 | 128 | 62 |
| 74.32 | 112 | 95 | 221 | 71.96 | 129 | 129 | 165 |
| 70.61 | 112 | 96 | 201 | 72.49 | 130 | 130 | 203 |
| 69.86 | 114 | 97 | 107 | 76.62 | 130 | 131 | 199 |
| 69.17 | 114 | 98 | 139 | 71.47 | 130 | 132 | 50 |
| 69.10 | 115 | 99 | 169 | 72.01 | 131 | 133 | 246 |
| 71.33 | 115 | 100 | 52 | 76.93 | 131 | 134 | 130 |

| | | | | | | | |
|---|---|---|---|---|---|---|---|
| 72.50 | 131 | 135 | 33 | 74.20 | 145 | 169 | 65 |
| 71.87 | 131 | 136 | 114 | 75.21 | 145 | 170 | 53 |
| 72.05 | 132 | 137 | 32 | 75.85 | 145 | 171 | 67 |
| 75.34 | 132 | 138 | 137 | 73.59 | 146 | 172 | 206 |
| 71.99 | 132 | 139 | 110 | 73.64 | 146 | 173 | 36 |
| 73.14 | 133 | 140 | 205 | 80.93 | 147 | 174 | 103 |
| 72.84 | 134 | 141 | 219 | 75.31 | 147 | 175 | 128 |
| 72.50 | 134 | 142 | 54 | 74.70 | 147 | 176 | 200 |
| 78.28 | 134 | 143 | 3 | 76.15 | 149 | 177 | 220 |
| 72.63 | 135 | 144 | 252 | 74.85 | 150 | 178 | 211 |
| 73.63 | 136 | 145 | 46 | 76.13 | 151 | 179 | 223 |
| 72.09 | 137 | 146 | 168 | 75.31 | 152 | 180 | 16 |
| 73.74 | 137 | 147 | 208 | 77.39 | 152 | 181 | 111 |
| 74.83 | 137 | 148 | 185 | 77.52 | 153 | 182 | 125 |
| 73.66 | 137 | 149 | 95 | 74.46 | 153 | 183 | 60 |
| 71.62 | 138 | 150 | 89 | 76.36 | 153 | 184 | 210 |
| 73.48 | 138 | 151 | 242 | 78.00 | 153 | 185 | 141 |
| 73.70 | 139 | 152 | 49 | 77.14 | 154 | 186 | 34 |
| 73.87 | 140 | 153 | 11 | 76.70 | 156 | 187 | 204 |
| 75.24 | 140 | 154 | 9 | 81.14 | 157 | 188 | 181 |
| 73.93 | 141 | 155 | 63 | 76.49 | 157 | 189 | 142 |
| 73.67 | 141 | 156 | 105 | 76.71 | 157 | 190 | 116 |
| 83.93 | 141 | 157 | 192 | 75.29 | 157 | 191 | 42 |
| 73.22 | 141 | 158 | 207 | 75.95 | 157 | 192 | 1 |
| 76.08 | 141 | 159 | 51 | 83.41 | 157 | 193 | 134 |
| 74.17 | 141 | 160 | 135 | 75.46 | 158 | 194 | 254 |
| 73.85 | 141 | 161 | 209 | 77.67 | 159 | 195 | 117 |
| 74.38 | 141 | 162 | 20 | 79.75 | 159 | 196 | 136 |
| 77.08 | 141 | 163 | 230 | 76.40 | 160 | 197 | 115 |
| 106.30 | 142 | 164 | 22 | 76.50 | 160 | 198 | 72 |
| 75.25 | 143 | 165 | 104 | 76.74 | 160 | 199 | 15 |
| 74.50 | 144 | 166 | 197 | 75.34 | 160 | 200 | 143 |
| 73.62 | 144 | 167 | 6 | 78.17 | 160 | 201 | 61 |
| 74.89 | 144 | 168 | 183 | 77.23 | 163 | 202 | 35 |

| | | | |
|---|---|---|---|
| 76.93 | 163 | 203 | 85 |
| 76.47 | 164 | 204 | 68 |
| 77.11 | 165 | 205 | 14 |
| 82.80 | 165 | 206 | 248 |
| 83.20 | 168 | 207 | 182 |
| 78.49 | 170 | 208 | 13 |
| 81.02 | 170 | 209 | 86 |
| 82.38 | 170 | 210 | 55 |
| 96.08 | 170 | 211 | 109 |
| 78.04 | 171 | 212 | 227 |
| 77.52 | 172 | 213 | 127 |
| 81.46 | 172 | 214 | 56 |
| 84.36 | 173 | 215 | 8 |
| 81.78 | 174 | 216 | 39 |
| 78.87 | 175 | 217 | 217 |
| 82.21 | 175 | 218 | 113 |
| 83.23 | 176 | 219 | 237 |
| 78.87 | 176 | 220 | 225 |
| 79.59 | 176 | 221 | 69 |
| 79.44 | 178 | 222 | 112 |
| 86.80 | 178 | 223 | 88 |
| 80.06 | 179 | 224 | 23 |
| 78.86 | 179 | 225 | 2 |
| 80.06 | 179 | 226 | 212 |
| 82.37 | 179 | 227 | 5 |
| 80.36 | 181 | 228 | 47 |
| 80.52 | 182 | 229 | 214 |
| 80.30 | 182 | 230 | 215 |
| 80.06 | 184 | 231 | 38 |
| 79.97 | 184 | 232 | 234 |
| 83.03 | 187 | 233 | 45 |
| 81.45 | 189 | 234 | 228 |
| 81.24 | 189 | 235 | 213 |
| 83.80 | 190 | 236 | 108 |

Fig. 18B(7)

| | | | |
|---|---|---|---|
| 82.10 | 191 | 237 | 229 |
| 81.04 | 191 | 238 | 37 |
| 83.91 | 192 | 239 | 239 |
| 82.43 | 193 | 240 | 231 |
| 83.63 | 193 | 241 | 226 |
| 86.59 | 193 | 242 | 236 |
| 83.65 | 194 | 243 | 232 |
| 83.36 | 196 | 244 | 24 |
| 88.75 | 200 | 245 | 41 |
| 87.85 | 200 | 246 | 44 |
| 83.78 | 201 | 247 | 43 |
| 88.59 | 201 | 248 | 21 |
| 85.75 | 201 | 249 | 233 |
| 87.26 | 202 | 250 | 40 |
| 90.94 | 202 | 251 | 12 |
| 83.36 | 204 | 252 | 48 |
| 87.90 | 210 | 253 | 235 |
| 90.08 | 212 | 254 | 238 |
| 89.13 | 213 | 255 | 216 |
| 88.80 | 215 | 256 | 240 |

Fig. 18B(8)

| Actinomycin D: Variance from mean | |
|---|---|
| A1 | -4.38 |
| C1 | 1.09 |
| G1 | 7.71 |
| T1 | -4.42 |
| A2 | -0.29 |
| C2 | 4.39 |
| G2 | -4.02 |
| T2 | -0.08 |
| A3 | 2.29 |
| C3 | -4.88 |
| G3 | 2.86 |
| T3 | -0.27 |
| A4 | -0.92 |
| C4 | 2.01 |
| G4 | 0.56 |
| T4 | -1.65 |

Fig. 21

| | N1N2 | N1N3 | N1N4 | N2N3 | N2N4 | N3N4 | XNX | XX |
|---|---|---|---|---|---|---|---|---|
| AA | -3.39 | -0.94 | -4.21 | 0.80 | -2.00 | 2.56 | -1.47 | -0.01 |
| AC | -3.00 | -10.57 | -2.04 | -3.61 | 2.28 | 1.72 | -4.14 | -1.63 |
| AG | -10.85 | -2.35 | -3.13 | 2.14 | 0.89 | 1.29 | -0.73 | -2.47 |
| AT | -0.25 | -3.64 | -8.12 | -0.49 | -2.33 | 3.58 | -2.98 | 0.95 |
| CA | 1.52 | 1.61 | -1.63 | 7.80 | 3.78 | -3.33 | 2.69 | 2.00 |
| CC | 2.14 | -2.89 | 4.97 | -4.43 | 4.63 | -5.45 | 0.87 | -2.58 |
| CG | -1.38 | 5.44 | 2.58 | 8.94 | 5.72 | -3.56 | 5.58 | 1.33 |
| CT | 2.08 | 0.20 | -1.55 | 5.26 | 3.44 | -7.19 | 1.82 | 0.05 |
| GA | -1.48 | 9.81 | 6.63 | 1.08 | -3.47 | -1.31 | 3.17 | -0.57 |
| GC | 23.80 | 2.40 | 7.64 | -7.41 | -1.51 | 9.80 | 0.44 | 8.73 |
| GG | 10.42 | 11.66 | 7.28 | -4.76 | -4.87 | 5.21 | 3.39 | 3.62 |
| GT | -1.89 | 6.96 | 9.30 | -5.00 | -6.22 | -2.27 | 0.37 | -3.05 |
| TA | 2.19 | -1.33 | -4.47 | -0.54 | -1.99 | -1.60 | -1.66 | 0.02 |
| TC | -5.36 | -8.47 | -2.54 | -4.07 | 2.63 | 1.95 | -2.92 | -2.49 |
| TG | -14.27 | -3.31 | -4.46 | 5.12 | 0.52 | -0.69 | -1.39 | -3.28 |
| TT | -0.26 | -4.59 | -6.22 | -0.84 | -1.49 | -0.72 | -3.04 | -0.61 |
| stdev: | 8.44 | 6.13 | 5.54 | 4.86 | 3.52 | 4.22 | 2.78 | 3.04 |

Fig. 22

| TTCCTTCC | TTACTTCC | TACCTTCC | TAACTTCC |
| --- | --- | --- | --- |
| TTCCTTAC | TTACTTAC | TACCTTAC | TAACTTAC |
| TTCCTACC | TTACTACC | TACCTACC | TAACTACC |
| TTCCTAAC | TTACTAAC | TACCTAAC | TAACTAAC |

TTCCNTTCC
TTCCNNTTCC
TTCCNNNTTCC
TTCCNNNNTTCC

```
              - →       — UL9 →   — →
5'-GCGTAN XYZZ CGTTCGCACTT XYZZ CTTCGTCCCAAT-3'      Score
3'-CGCATN YXQQ GCAAGCGTGAA YXQQ GAAGCAGGGTTA-5'      high
                    Fig. 27A — UL9 →
5'-GCGTAN QQXY CGTTCGCACTT QQXY CTTCGTCCCAAT-3'      Score
3'-CGCATN ZZYX GCAAGCGTGAA ZZYX GAAGCAGGGTTA-5'      low
           ← -             ← —
                    Fig. 27B

- →                   — →
5'-GCGTAN XYZZ AAGTGCGAACG XYZZ CTTCGTCCCAAT-3'
3'-CGCATN YXQQ TTCACGCTTGC YXQQ GAAGCAGGGTTA-5'
              ← -UL9- -
                    Fig. 27C

5'-GCGTAN QQXY AAGTGCGAACG QQXY CTTCGTCCCAAT-3'
3'-CGCATN ZZYX TTCACGCTTGC ZZYX GAAGCAGGGTTA-5'
    ← -  ← -UL9- -  ← —
                    Fig. 27D

- →     — UL9→
5'-GCGTAN XYZZ CGTTCGCACTT QQXY CTTCGTCCCAAT-3'
3'-CGCATN YXQQ GCAAGCGTGAA ZZYX GAAGCAGGGTTA-5'
                            ← —
                    Fig. 27E

— UL9 →  - →
5'-GCGTAN QQXY CGTTCGCACTT XYZZ CTTCGTCCCAAT-3'
3'-CGCATN ZZYX GCAAGCGTGAA YXQQ GAAGCAGGGTTA-5'
            ← —
                    Fig. 27F

- →
5'-GCGTAN XYZZ AAGTGCGAACG QQXY CTTCGTCCCAAT-3'
3'-CGCATN YXQQ TTCACGCTTGC ZZYX GAAGCAGGGTTA-5'
              ← -UL9- -  ← —
                    Fig. 27G

- →
5'-GCGTAN QQXY AAGTGCGAACG XYZZ CTTCGTCCCAAT-3'
3'-CGCATN ZZYX TTCACGCTTGC YXQQ GAAGCAGGGTTA-5'
    ← —    ← UL9— -
                    Fig. 27H
```

```
          HIVBH101 (HIV LTR sequence)
GTTAGAGTGG AGGTTTGACA GCCGCCTAGC ATTTCATCAC ATGGCCCGAG AGCTGCATCC GGAGTACTTC AAGAACTGCT GACATCGAGC TTGCTACAAG
  <<NF-κB>>        <<NF-κB>>        <Sp-1 III    <Sp-1 II    <
GGACTTTCCG CTGGGGACTT TCCAGGGAGG CGTGGCCTGG GCGGGACTGG
Sp-1 II>                           TATA
GGAGTGGCGA GCCCTCAGAT CCTGCATATA AGCAGCTGCT TTTTGCCTGT
                 +1 prim transcript start →
ACTG GGTCTCTCTG GTTAGACCAGA TCTGAGCCTGGGAGCTC
```

Fig. 28

```
       EcoRI/PstI
         primer
5'-GCAGAATTCTGCAG-3'         UL9 site
5'-GCAGAATTCTGCAG(N)ₓCGTTCGCACTTTCTAGAGCTCAGG-3'
3'-CGTCTTAAGACGTC(N)ₓGCAAGCGTGAAAGATCTCGAGTCC-5'
                                3'-AGATCTCGAGTCC-5'
             test                    XbaI/SacI
             site                      primer
where X is the number of bases in the test site.
```

Fig. 29A

5'-GCAGAATTCTGCAGNNNNCGTTCGCACTTTCTAGAGCTCAGG-3'

Fig. 29B

5'-GCAGAATTCTGCAGNNNNNNNNCGTTCGCACTTTCTAGAGCTCAGG-3'

Fig. 29C

5'-GCAGAATTCTGCAGCGTTCGCACTTNNNNNNNNNTCTAGAGCTCAGG-3'

Fig. 29D

UL9 Site 3' relative to the test sequence:

```
        primers
      EcoRI/PstI
5'-CGTGAATTCTGCAG-3'
5'-CGTGAATTCTGCAGATG-3'
```

```
                 Asp718/RsaI/KpnI
                    restriction
                       site          UL9 site
5'-CGTGAATTCTGCAGATGAGGTACCNNNNNNNCGTTCGCACTTTCTAGAGCTCTCC
                             test
                             site       GTGAAAGATCTCGAGAGG-5'
                                          AAGATCTCGAGAGG-5'
                                            XbaI/SacI
                                              primers
```

Fig. 30

| Small Molecule Binding Sequence | Expected Score in Assay | Potential Test Site Sequence |
|---|---|---|
| UL9 site<br>5'-...CGTTCGCACTTTTAC...-3' | high | TTAC |
| 5'-...CGTTCGCACTTTACN...-3' | high | TACN |
| 5'-...CGTTCGCACTTACNN...-3' | high | ACNN |

Fig. 31

| Small Molecule Binding Sequence | Expected Score in Assay | Potential Test Site Sequence |
|---|---|---|
| SmaI<br>5'-...CCCGGGTTAC...-3' | high | TTAC |
| 5'-...CCCGGGTACN...-3' | low | TACN |
| 5'-...CCCGGGACNN...-3' | low | ACNN |

Fig. 32

SEQUENCE DIRECTED DNA BINDING MOLECULES COMPOSITIONS AND METHODS

This application is a continuation of co-owned, U.S. patent application Ser. No. 08/482,080, filed Jun. 7, 1995, issued as U.S. Pat. No. 6,010,849 on Jan. 4, 2000; which is a divisional of co-owned, U.S. application Ser. No. 08/171,389, filed Dec. 20, 1993, issued as U.S. Pat. No. 5,578,444 on Nov. 26, 1996; which is a continuation-in-part of co-owned, U.S. application Ser. No. 08/123,936, filed Sep. 17, 1993, issued as U.S. Pat. No. 5,726,014 on Mar. 10, 1998; which is a continuation-in-part of co-owned, U.S. application Ser. No. 07/996,783, filed Dec. 23, 1992, issued as U.S. Pat. No. 5,693,463 on Dec. 2, 1997; which is a continuation-in-part of co-owned, U.S. application Ser. No. 07/723,618, filed Jun. 27, 1991, now abandoned; each of which is expressly incorporated by reference, herein.

FIELD OF THE INVENTION

The present invention relates to methods, systems, and kits useful for the identification of molecules that specifically bind to defined nucleic acid sequences. Also described are methods for designing molecules having the ability to bind defined nucleic acid sequences and compositions thereof.

References

Ambinder, R. F., et al., *J. Virol.* 65:1466–1478 (1991).
Angel, P., et al., Nature 332:166 (1988).
Ausubel, F. M., et al., *Current Protocols in Molecular Biology*, John Wiley and Sons, Inc., Media Pa.
Baguley, B. C., *Mol. Cell. Bioch.* 43:167–181 (1982).
Banerji, S. S., et al., *Mol. Cell Biol.* 11:4074–4087 (1991).
Beal, P. A., et al., *Science* 251:1360–1363 (1991).
Becker, Y., et al., *Isr. J. Med. Sci.* 8:1225 (1972).
Bialer, M., et al., *J. Med. Chem.* 23:1144 (1980).
Bialer, M., et al., *J. Pharm. Sci.* 70:822 (1981).
Birg, F., et al., *Nucl. Acids Res.* 18:2901–2908 (1990).
Bohmann, D., et al., Science 238:1386 (1987).
Bos, T. J., et al., Cell 52:705 (1988).
Chaiet, L., et al., *Arch. Biochem. Biophys.* 106:1 (1964).
Chaires, J. B., et al., *Biochemistry* 29:6145–6153 (1990).
Chang, H.-K, et al., *Mol. Cell. Biol.* November:5189–5197 (1989).
Chen, K-X., et al., *J. Biomol. Struct. Dyn.* 3:445–466 (1985).
Chin, M. T., et al., *J. Virol.* 63:2967–2976 (1989).
Comai, L., et al., *Cell* 68:965–976 (1992).
Cooney, M., et al., *Science* 241:456–459 (1988).
Courtois, G., et al., *Proc. Natl. Acad. Sci. USA* 85:7937–7941 (1988).
Cullinane, C., et al., *FEBS Lett.* 293:195–198 (1991).
Debart, F., et al., *J. Med. Chem.* 32:1074 (1989).
Dervan, P. B., Science 232:464–471 (1986).
Descheemaeker, K. A., et al., *J. Biol. Chem.* 267(21):15086 (1992).
Edwards, C. A. et al., *J. Mol. Biol.* 180:73–90 (1984).
Edwards, C. A., et al., in: *Advances in Regulation of Cell Growth, Volume I: Regulation of Cell Growth and Activation*, edited by Mond, J. J., et al., New York: Raven Press, p. 91–118 (1989).
Elias, P., et al., *Proc. Natl. Acad. Sci. USA* 85:2959–2963 (1988).
Fox, K. R., et al., *Biochim. Biophys. Acta* 840:383–392 (1985).
Fox, K. R., et al., *Nucl. Acids Res.* 16:2489–2507 (1988).
Fox, K. R., et al., *Nucl. Acids Res.* 18:1957–1963 (1990).
Fox, K. R., et al., *Biochem J.* 269:217–221.
Fried, M. G., et al., *Nuc. Acid. Res.* 9:6505 (1981).
Galas, D., et al., *Nuc. Acid Res.* 5:3157–3170 (1981).
Garner, M. M., et al., *Nuc. Acid. Res.* 9:3047 (1981).
Gaugain, B., et al., *Biochemistry* 17:5071 (1978).
Gessner, R. V., et al., *Biochemistry* 24:237–240 (1985).
Gilbert, D. F., et al., *Proc. Natl. Acad. Sci. USA* 86:3006 (1988).
Gilman, A. G., et al., eds., *The Pharmacological Basis of Therapeutics*, Eighth Edition, Pergamon Press (1990).
Goldin, A. L., et al., *J. Virol.* 38:5–58 (1981).
Goodisman, J., et al., *Biochemistry* 31:1046–1058 (1992).
Green, N. M., *Adv. Protein Chem.* 29:85 (1975).
Greenblatt, J., *Cell* 66:1067–1070 (1991).
Greene, W. C., *Annu. Rev. Immunol.* 8:453–475 (1990).
Griffen, J. H., et al., *J. Am. CHem. Soc.* (1992).
Griffin, L. C., et al., *Science* 245:967–971 (1989).
Gross, D. S., et al., *Annu. Rev. Biochem.* 57:159–197 (1988).
Gurskii, G.V., et al., *Mol. Biol.* 19:177 (1985).
Harlow, E., et al., *Antibodies: A Laboratory Manual*, Cold Spring Harbor Laboratory Press (1988).
Harshman, K. D., et al., Cell 53:321 (1988).
Hausheer, F. H., et al., *Anti-Cancer Drug Design* 5:159–167 (1990).
Hawley, R. C., et al., *Proc. Natl. Acad. Sci. USA* 86:1105–1109 (1989).
Helene, C., et al., *Biochim. Biophys. Acta* 1049:99–125 (1990).
Helene, C., et al., *Genome* 31:413–420 (1989).
Hoogsteen, *Acta Cryst.* 12 822 (1959).
Innis et al., eds. *PCR Protocols, a Guide to Methods and Applications*, Academic Press, Inc. (1992).
Jain, S. C., et al., *J. Mol. Biol.* 68:1–20 (1972).
Jeppesen, C., et al., *Eur. J. Biochem.* 182:437–444 (1989).
Kadonaga, J. T., *PNAS*, 83:5889–5893 (1986).
Kissinger, K., et al., *Biochemistery* 26:5590 (1987).
Kitadai, Y., et al., *Biochem. Biophys. Res. Commun.* 189(3):1342 (1992).
Koff, A., et al., *J. Virol.* 62:4096–4103 (1988).
Kotler, M., et al., *FEBS.Lett.* 21:222 (1972).
Krowicki, K., et al., *J. Org. Chem.* 52:3493 (1987).
Kuhlmann, K. F., et al., *Nucl. Acids Res.* 5:2629 (1978).
Laugaa, P., et al., *Biochemistry* 23:1336 (1985).
Le Pecq, J. B., et al., *Proc. Natl. Acad. Sci. U.S.A.* 72:2915–2919 (1975).
Lee, D. K., et al., *Cell* 67:1241–1250 (1991).
Lown, J. W., et al., *J. Org. Chem.* 50:3774 (1985).
Lown, J. W., et al., *J. Med. Chem.* 29:1210 (1986).
Luck, G., et al., *Nucl. Acids Res.* 1:503 (1974).
Luckow, V. A., et al., *Virology* 170:31 (1989).
Maher III, L. J., et al., *Science* 245:725–730 (1989).
Maher, L. J., et al., *Biochemistry* 31(1):70–81 (1992).
Maniatis, T., et al. *Molecular Cloning: A Laboratory Manual*, Cold Spring Harbor Laboratory (1982).
Maxam, A. M., et al., *Meth. Enzymol.*, 65:499 (1980).
McGeoch, D. J., et al., *J. Virol.* 62:444–453 (1988).
Meijer, I., et al., *Cell-Immunol.* 145(1):56 (1992).
Miller, et al., U.S. Pat. No. 4,757,055, issued Jul. 19, 1988.
Montenay-Garestier, T., et al., *CIBA Found. Symp.* 158:147–157.
Mullis, K. B., U.S. Pat. No. 4,683,202, issued Jul. 28, 1987.
Mullis, K. B., et al., U.S. Pat. No. 4,683,195, issued Jul. 28, 1987.
Nakamura, S., et al., *J. Antiobiot., Ser. A.* 17:220 (1964).
Neuberg, M., et al., *Oncogene* 6(8):1325 (1991).
Olivo, P. D., et al., *Proc. Natl. Acad. Sci. USA* 85:5414–5418 (1988).

Olivo, P. D., et al., *J. Virology* 3:196–204 (1989).
Pelaprat, D., et al., *J. Med. Chem.* 23:1336–1343 (1980).
Perouault, L., et al., *Nature* 344:358–360 (1990).
Phillips, D. R., *Anti Cancer Drug Design* 5:21–29 (1990).
Phillips, et al., *Biochemisty* 29:4812–4819 (1990).
Pitha, *Biochem. Biophys. Acta* 204:39 (1970a).
Pitha, *Biopolymers* 9:965 (1970b).
Portugal, J., et al., *FEBS Lett.* 225:195–200 (1987).
Quigley, G. J., et al., *Science* 232:1255–1258 (1986).
Raney, A. K., et al., *J. Virol.* 66(12):6912 (1992).
Reisman, D., et al., *Mol. Cell. Biol.* 5:1822–1832 (1985).
Remers, W. A., *Antineoplastic Agents*, New York: John Wiley and Sons, Inc., 1992.
Rice, J. A., et al., *Proc. Natl. Acad. Sci. USA* 85:4158–4161 (1988).
Ryder, K., et al., *Proc. Natl. Acad. Sci. USA* 85:1487 (1988).
Salas, X., et al., *FEBS Lett.* 292:223–228 (1991).
Sambrook, J., et al., *In Molecular Cloning: A Laboratory Manual*, Cold Spring Harbor Laboratory Press, Vol. 2 (1989).
Sanger, F., et al., *Proc Nat Acad Sci, USA*, 74:5363 (1977).
Schmidt, A., et al., *J. Virol.* 64:4037–4041 (1990).
Schultz, P. G., et al., *Proc. Natl. Acad. Sci. USA* 80:6834–6837 (1983).
Schuhmann, E., et al., *Allg. Microbiol.* 14:321 (1974).
Shaw, J. P., et al., *Science* 241:202 (1988).
Sherman, S. E., et al., *Chem. Rev.* 87:1153 (1987).
Siebenlist, U., et al., *Proc. Natl. Acad. Sci. USA* 77:122–126 (1980).
Skorobogaty, A., et al., *Anti-Cancer Drug Design* 3:41–56 (1988).
Smith, D. B., et al., *Gene* 67:31 (1988).
Sobell, H. M., et al., *J. Mol. Biol.* 68:21–34 (1972).
Sobell, H. M., *Prof. Nucl. Acid. Res. Mol. Biol.* 13:153–190 (1973).
Stow, N. D., et al., *Virology* 130:427–438 (1983).
Stow, N. D., et al., *J. Gen. Virol.* 67:1613–1623 (1986).
Strobel, S. A., et al., *Science* 249:73–75 (1990).
Summers, M. D., et al., *A Manual of Methods for Baculovirus Vectors and Insect Cell Culture Procedures*, Texas Agricultural Experimental Station Bulletin, No. 1555 (1987).
Summerton, J., et al., PCT International Application, Publication No. WO 86/05518, Published Sep. 25, 1986.
Summerton, J., et al., U.S. Pat. No. 5,034,506, issued Jul. 23, 1991.
Thompson, C. B., et al., *Molecular and Cell Biology* 12(3):1043 (1992).
Thrum, H., et al., *Antiomicrobial and Antineoplastic Chemotherapy*, Prague: Czech. Med. Press, pp. 819–822 (1972).
Tullius, T. D., *Ann. Rev. Biophys. Biochem.* 18:213–237 (1989).
Wang, A. H.-J., et al., *Science* 225:1115–1121 (1984).
Wartel, R. M., et al., *J. Biol. Chem.* 15:285–318 (1975).
Weir, H. M., et al., *Nucl. Acids Res.* 17:1409–1425 (1989).
Werner, G. H., et al., *Actual. Pharmaceut. Fr.* 21:133 (1963).
White, R. J., et al., *Biochemistry* 28:6259–6269 (1989).
Wirth, T., et al., *EMBO J.* 7(10):3109 (1988).
Woodbury, C. P., et al., *Biochemistry* 22(20):4730–4737 (1983).
Wu, C. A., et al., *J. Virol.* 62:435–443 (1988).
Young, S. L., et al., *Proc. Natl. Acad. Sci. U.S.A.* 88:10023–10026 (1991).
Zein, N., et al., *Science* 240:1198 (1988).
Zimmer, C., *Pros. Nucl. Acid Res. Mol. Biol.* 15:285–318 (1975).

BACKGROUND OF THE INVENTION

Several classes of small molecules that interact with double-stranded DNA have been identified. Many of these small molecules have profound biological effects. For example, many aminoacridines and polycyclic hydrocarbons bind DNA and are mutagenic, teratogenic, or carcinogenic. Other small molecules that bind DNA include: biological metabolites, some of which have applications as antibiotics and antitumor agents including actinomycin D, echinomycin, distamycin, and calicheamicin; planar dyes, such as ethidium and acridine orange; and molecules that contain heavy metals, such as cisplatin, a potent antitumor drug.

The sequence binding preferences of most known DNA binding molecules have not, to date, been identified. However, several small DNA-binding molecules have been shown to preferentially recognize specific nucleotide sequences, for example: echinomycin has been shown to preferentially bind the sequence [(A/T)CGT]/[ACG(A/T)] (Gilbert et al.); cisplatin has been shown to covalently cross-link a platinum molecule between the N7 atoms of two adjacent deoxyguanosines (Sherman et al.); and calicheamicin has been shown to preferentially bind and cleave the sequence TCCT/AGGA (Zein et al.).

Many therapeutic DNA-binding molecules (such as distamycin) that were initially identified based on their therapeutic activity in a biological screen have been later determined to bind DNA. There are several examples in the literature referring to synthetic or naturally-occurring polymers of DNA-binding drugs. Netropsin, for example, is a naturally-occurring oligopeptide that binds to the minor groove of double-stranded DNA. Netropsin contains two 4-amino-1-methylpyrrole-2-carboxylate residues and belongs to a family of similar biological metabolites from Streptomyces spp. This family includes distamycin, anthelvencin (both of which contain three N-methylpyrrole residues), noformycin, ainidomycin (both of which contain one N-methylpyrrole residue) and kikumycin (which contains two N-methylpyrrole residues, like netropsin) (Debart, et al.). Synthetic molecules of this family have also been described, including the above-mentioned molecules (Lown, et al. 1985) well as dimeric derivatives (Griffin et al., Gurskii, et al.) and certain analogues (Bialer, et al. 1980, Bialer, et al. 1981, Krowicki, et al.).

Molecules in this family, particularly netropsin and distamycin, have been of interest because of their biological activity as antibacterial (Thrum et al., Schuhmann, et al.), antiparasitic (Nakamura et al.), and antiviral drugs (Becker, et al., Lown, et al. 1986, Werner, et al.).

Among the synthetic analogs of netropsin and distamycin are oligopeptides that have been designed to have sequence preferences different from their parent molecules. Such oligopeptides include the "lexitropsin" series of analogues. The N-methlypyrrole groups of the netropsin series were systematically replaced with N-methylimidazole residues, resulting in lexitropsins with increased and altered sequence specificities from the parent compounds (Kissinger, et al.). Further, a number of poly(N-methylpyrrolyl)-netropsin analogues have been designed and synthesized which extend the number of residues in the oligopeptides to increase the size of the binding site (Dervan, 1986).

There are several different approaches that could be taken to look for small molecules that specifically inhibit the interaction of a given DNA-binding protein with its binding sequence (cognate site). One approach would be to test biological or chemical compounds for their ability to preferentially block the binding of one specific DNA:protein interaction but not others. Such an assay would depend on the development of at least two, preferably three, DNA:protein interaction systems in order to establish controls for distinguishing between general DNA-binding molecules (polycations like heparin or intercalating agents like ethidium) and DNA-binding molecules having sequence binding preferences that would affect protein/cognate binding site interactions in one system but not the other(s).

One illustration of how this system could be used is as follows. Each cognate site could be placed 5' to a reporter gene (such as genes encoding β-galactoside or luciferase) such that binding of the protein to the cognate site would enhance transcription of the reporter gene. The presence of a sequence-specific DNA-binding drug that blocked the DNA:protein interaction would decrease the enhancement of the reporter gene expression. Several DNA enhancers could be coupled to reporter genes, then each construct compared to one another in the presence or absence of small DNA-binding test molecules. In the case where multiple protein/cognate binding sites are used for screening, a competitive inhibitor that blocks one interaction but not the others could be identified by the lack of transcription of a reporter gene in a transfected cell line or in an in vitro assay. Only one such DNA-binding sequence, specific for the protein of interest, could be screened with each assay system. This approach has a number of limitations including limited testing capability and the need to construct the appropriate reporter system for each different protein/cognate site of interest.

Another example of a system to detect sequence-specific DNA-binding molecules would involve cloning a DNA-binding protein of interest, expressing the protein in an expression system (e.g., bacterial, baculovirus, or mammalian expression systems), preparing a purified or partially purified sample of protein, then using the protein in an in vitro competition assay to detect molecules that blocked the DNA:protein interaction. These types of systems are analogous to many receptor:ligand or enzyme:substrate screening assays developed in the past, but have the same limitations as outlined above in that a new system must be developed for every different protein/cognate site combination of interest. The capacity for screening numerous different sequences is therefore limited.

Another example of a system designed to detect sequence-specific DNA-binding drugs would be the use of DNA footprinting procedures as described in the literature. These methods include DNase I or other nuclease footprinting (Chaires, et al.), hydroxy radical footprinting (Portugal, et al.), methidiumpropyl EDTA(iron) complex footprinting (Schultz, et al.), photofootprinting (Jeppesen, et al.), and bidirectional transcription footprinting (White, et al.). These procedures are likely to be accurate within the limits of their sequence testing capability but are seriously limited by (i) the number of different DNA sequences that can be used in one experiment (typically one test sequence that represents the binding site of the DNA-binding protein under study), and (ii) the difficulty of developing high throughput screening systems.

SUMMARY OF THE INVENTION

In one aspect, the invention includes a method of constructing a DNA-binding agent capable of sequence-specific binding to a duplex DNA target region. The method includes identifying in the duplex DNA, a target region containing a series of at least two non-overlapping base-pair sequences of four base-pairs each, where the four base-pair sequences are adjacent, and each sequence is characterized by sequence-preferential binding to a duplex DNA-binding small molecule. The small molecules are coupled to form a DNA-binding agent capable of sequence-specific binding to said target region.

In one embodiment, the duplex-binding small molecules are identified as molecules capable of binding to a selected test sequence in a duplex DNA by first adding a molecule to be screened to a test system composed of (a) a DNA-binding protein that is effective to bind to a screening sequence in a duplex DNA, with a binding affinity that is substantially independent of the test sequence adjacent the screening sequence, but that is sensitive to binding of molecules to such test sequence, when the test sequence is adjacent the screening sequence, and (b) a duplex DNA having said screening and test sequences adjacent one another, where the binding protein is present in an amount that saturates the screening sequence in the duplex DNA.

The test molecule is incubated in the test system for a period sufficient to permit binding of the molecule being tested to the test sequence in the duplex DNA. The degree of binding protein bound to the duplex DNA before adding the test molecule is compared with that after adding the molecule. The screening sequence may be from the HSV origin of replication, and the binding protein may be UL9. Exemplary screening sequences are identified as SEQ ID NO:601, SEQ ID NO:602, SEQ ID NO:615, and SEQ ID NO:641.

Specific examples of tetrameric basepair sequences include TTTC, TTTG, TTAC, TTAG, TTGC, TTGG, TTCC, TTCG, TATC, TATG, TAAC, TAAG, TAGC, TAGG, TACC, TAGC sequences. A specific example of a small molecule capable of binding to these sequences is distamycin.

In another aspect:, the invention includes a method of blocking transcriptional activity from a duplex DNA template. The method includes identifying in the duplex DNA, a binding site for a transcription factor and, adjacent the binding site, a target region having a series of at least two non-overlapping tetrameric base-pair sequences, where the four (tetrameric) base-pair sequences are adjacent and each sequence is characterized by sequence-preferential binding to a duplex DNA-binding small molecule. The sequences are contacted with a binding agent composed of the small molecules coupled to form a DNA-binding agent capable of sequence-specific binding to said target region.

The target may be selected, for example, from DNA sequences adjacent a binding site for a eucaryotic transcription factor, such as transcription factor TFIID, or a procaryotic transcription factor, such as transcription sigma factor.

For mammalian transcription factors, the target region is typically chosen from non-conserved regions adjacent the transcription factor binding site. Target regions can be chosen so that the small molecule binding overlaps an adjacent transcription factor DNA binding sequence (e.g., for a TFIID binding site, by 1–3 nucleotide pairs). In this case, the specificity of DNA binding for the small molecule is essentially derived from the non-conserved sequences adjacent the transcription factor binding site, in order to reduce small molecule binding at the transcription factor binding site associated with other genes.

Also disclosed is a DNA-binding agent capable of binding with base-sequence specificity to a target region in duplex DNA, where the target region contains at least two adjacent four base-pair sequences. The agent includes at least two subunits, where each subunit is a small molecule which has a sequence-preferential binding affinity for a sequence of four base-pairs in the target region. The subunits are coupled to form a DNA-binding agent capable of sequence-specific binding to said target region.

In one general embodiment, the agent is designed for binding to a sequence in which the two tetrameric basepair sequences are separated (for example, by up to 20 basepairs, typically, 1 to 6 basepairs) and the small molecules in the agent are coupled to each other by a spacer molecule.

Also forming part of the invention is a method of constructing a binding agent capable of sequence-specific binding to a duplex DNA target region. The method includes identifying in the duplex DNA, a target region containing (i) a series of at least two adjacent non-overlapping base-pair sequences of four base-pairs each, where each four base-pair sequence is characterized by sequence-preferential biding to a duplex DNA-binding small molecule, and (ii) adjacent to (i) a DNA duplex region capable of forming a triplex with a third-strand oligonucleotide. The two small molecules are coupled to form a DNA-binding agent capable of sequence-specific binding to said target region, and the DNA-binding agent is attached to a third-strand oligonucleotide.

The binding of the DNA-binding agent to duplex DNA causes a shift from B form to A form DNA, allowing triplex binding between the third-strand polynucleotide and a portion of the target sequence.

Also disclosed is a triple-strand forming agent for use in practicing the method.

In still another aspect, the invention includes a method of ordering the sequence binding preferences a DNA-binding molecule. The method includes adding a molecule to be screened to a test system composed of (a) a DNA-binding protein that is effective to bind to a screening sequence in a duplex DNA with a binding affinity that is substantially independent of such test sequence adjacent the screening sequence, but that is sensitive to binding of molecules to such test sequence, and (b) a duplex DNA having said screening and test sequences adjacent one another, where the binding protein is present in an amount that saturates the screening sequence in the duplex DNA. The molecule in the test system is incubated for a period sufficient to permit binding of the molecule being tested to the test sequence in the duplex DNA, and the amount of binding protein bound to the duplex DNA before and after addition of the test molecule is compared. These steps are repeated using all test sequences of interest, and the sequences are then ordered on the basis of relative amounts of protein bound in the presence of the molecule for each test sequence.

The test sequences are selected, for example, from the group of 256 possible four base sequences composed of A, G, C and T. The DNA screening sequence is preferably from the HSV origin of replication, and the binding protein is preferably UL9.

The invention also includes, a method for altering the binding characteristics of a DNA-binding protein to a duplex DNA. In the method, a binding site for the DNA-binding protein is identified in the duplex DNA and a target region identified adjacent the binding site. A small molecule is selected that is characterized by sequence-preferential binding to the target region. Such molecules can be selected by the assay and methods of the present invention. When the small molecule is bound to the target region, the small molecule is typically adjacent to the binding site for the DNA-binding protein. Alternatively, the binding of the small molecule may overlapping the site for the DNA-binding protein by at least one nucleotide pair. In the case of such overlap, the specificity of DNA binding for the small molecule is essentially derived from non-conserved sequences adjacent the DNA-binding protein's binding site—in order to reduce small molecule binding at similar DNA:protein binding sites at other locations. Finally, the duplex DNA is contacted with the small molecule at a concentration effective to alter binding of the DNA-binding protein to its binding site.

In this method, contacting the duplex DNA with a small molecule can either inhibit or enhance the binding of the DNA-binding protein to its binding site: depending on the small molecule that is selected. Exemplary DNA binding proteins include DNA replication factors and a variety of transcription factors.

One application of this method is to eucaryotic general transcription factors (e.g., TFIID), where the target region is typically selected from DNA sequences adjacent the binding site for the eucaryotic transcription factor (e.g., SEQ ID NO:1 to SEQ ID NO:600). In one embodiment, the DNA binding protein is a eucaryotic general transcription factor and the small molecule binds, in addition to the target region, 1 to three nucleotide pairs of the DNA-binding protein's binding site. In the case of TFIID, the small molecule typically binds to (i) the target region, and (ii) up to two nucleotides of the binding site for TFIID, where the nucleotides are contiguous to the target region.

Generally, the present invention provides a method of screening for molecules capable of binding to a selected test sequence in a duplex DNA. In the method of the present invention a test sequence of interest is selected. Such sequences can be selected, for example, from the group of sequences presented as SEQ ID NO:1 to SEQ ID NO:600. Alternatively, the test sequences can be sequences having randomly generated sequences or defined sets of sequences, such as, the group of 256 possible four base sequences composed of A, G, C and T.

A duplex DNA test oligonucleotide is constructed having a screening sequence adjacent a selected test sequence, where a DNA binding protein is effective to bind to the screening sequence with a binding affinity that is substantially independent of the adjacent test sequence. In such constructs the DNA protein binding to the screening sequence is sensitive to binding of test molecules to the test sequence.

Molecules selected for testing/screening are added to a test system composed of (a) the DNA binding protein, and (b) the duplex DNA test oligonucleotide, which contains the screening and test sequences adjacent one another. Selected molecules are incubated in the test system for a period sufficient to permit binding of the molecule being tested to the test sequence in the duplex DNA. The amount of binding protein bound to the duplex DNA is compared before and after adding a test molecule. Comparison of the amount of binding protein bound to the duplex DNA before and after adding a test molecule can be accomplished, for example, using a gel band-shift assay or a filterbinding assay.

In the method of the present invention a number of DNA:protein interactions may be used for screening purposes. In one embodiment, the DNA screening sequence is from the HSV origin of replication and the binding protein is UL9. Exemplary HSV origin of replication screening sequences include SEQ ID NO:601, SEQ ID NO:602, SEQ ID NO:615, and SEQ ID NO:641.

Other DNA:protein interactions useful in the practice of the present invention include restriction endonucleases and their cognate DNA-binding sequences. These reactions are typically carried out in the absence of divalent cations.

In another embodiment, the invention includes a method of identifying test sequences in duplex DNA to which binding of a test molecule is most preferred. In this method a mixture of duplex DNA test oligonucleotides is constructed, where each oligonucleotide has a screening sequence adjacent a test sequence as described above. The test oligonucleotides of the mixture typically contain different test sequences.

A test molecule, to be screened, is added to a test reaction composed of (a) the DNA binding protein, and (b) the duplex DNA test oligonucleotide mixture. The molecule is incubated in the test reaction for a period sufficient to permit binding of the compound being tested to test sequences in the duplex DNA. Test oligonucleotides are separated from test oligonucleotides bound to binding protein.

The test oligonucleotides can be separated from test oligonucleotides bound to protein by, for example, passing the test reaction through a filter, where the filter is capable of capturing DNA:protein complexes but not DNA that is free of protein. One filter type useful in the practice of the present invention is the nitrocellulose filter.

The separated test oligonucleotides are then amplified. These amplified test oligonucleotides are then recycled through the screening steps of the assay in order to obtain a desired degree of selection. The amplified test oligonucleotides are isolated and sequenced.

Exemplary test sequences include sequences selected from the group of 256 possible four base sequences composed of A, G, C and T. Further examples of desirable test sequences include test sequences derived from the sequences presented as SEQ ID NO:1 to SEQ ID NO:600.

The amplification step in the method may be accomplished by polymerase chain reaction or other methods of amplification, including, cloning and subsequent in vivo amplification of the cloning vector containing the sequences of interest.

These and other objects and features of the invention will be more fully appreciated when the following detailed description of the invention is read in conjunction with the accompanying drawings.

BRIEF DESCRIPTION OF THE FIGURES

FIG. 4 also shows the preparation of double-stranded oligonucleotides end-labeled with either digoxigenin or $^{32}P$ (SEQ ID NO: 614-DDD).

FIG. 5 shows a series of sequences that have been tested in the assay of the present invention for the binding of sequence-specific small molecules. Test sequences shown are: UL9Z1, SEQ ID NO: 603; UL9Z2, SEQ ID NO: 604; UL9 CCCG, SEQ ID NO: 605; UL9 GGGC, SEQ ID NO: 606; UL9 ATAT, SEQ ID NO: 607; UL9 polyA, SEQ ID NO: 608; UL9 polyT, SEQ ID NO: 609; UL9 GCAC, SEQ ID NO: 610; ATori-1, SEQ ID NO: 611; oriEco2, SEQ ID NO: 612; oriEco3, SEQ ID NO: 613.

FIG. 10A shows the effect of the addition of several concentrations of distamycin A to DNA:protein assay reactions utilizing different test sequences.

FIG. 11A illustrates a DNA capture system of the present invention utilizing biotin and streptavidin coated magnetic beads. The presence of the DNA is detected using an alkaline-phosphatase substrate that yields a chemiluminescent product.

FIG. 11B shows a similar reaction using biotin coated agarose beads that are conjugated to streptavidin, that in turn is conjugated to the captured DNA.

FIG. 12 demonstrates a test matrix based on DNA:protein-binding data. Test oligonucleotides shown have the sequences identified as SEQ ID NO: 643 to SEQ ID NO: 654.

FIGS. 13A–13B list the top strands (5'-3') of all the possible four base pair sequences that could be used as a defined set of ordered test sequences in the assay.

FIG. 14A lists the top strands (5'-3') of all the possible four base pair sequences that have the same base composition as the sequence 5'-GATC-3'. This is another example of a defined, ordered set of sequences that could be tested in the assay.

FIG. 14B presents the general sequence of a test oligonucleotide (SEQ ID NO:617), where XXXX is the test sequence and N=A,G,C, or T.

FIGS. 15A–15B show the results of 4 duplicate experiments in which the binding activity of distamycin was tested with all possible (256) four base pair sequences. The oligonucleotides are ranked from 1 to 256 (column 1, "rank") based on their average rank from the four experiments (column 13, "ave. rank"). (rank is shown in the first column of the chart).

FIG. 18 shows the results of eight experiments with actinomycin D. The r % scores and rank are shown for each of the 256 oligonucleotides.

FIG. 21 shows the results of a position analysis for actinomycin D preference.

FIG. 22 presents the data for a dinucleotide analysis of actinomycin D binding preference.

FIG. 25 shows the top strands of 16 possible duplex DNA target sites for binding bis-distamycins.

FIG. 26 shows examples of bis-distamycin target sequences for bis-distamycins with internal flexible and/or variable length linkers targeted to sites comprised of two TTCC sequences, where N is any base. Test sequences are identified as SEQ ID NO: 655 to SEQ ID NO: 658.

FIGS. 27A to 27H show sample oligonucleotides for competition binding studies using the assay of the present invention. Test sequences are identified as SEQ ID NO: 621 to SEQ ID NO: 624.

FIG. 28 shows the DNA sequences of the HIV pro-viral promoter region. (SEQ ID NO: 627). Several transcription factor binding sites are marked.

FIGS. 29A to 29D illustrate sample test oligonucleotides for use in the polymerase chain reaction based selection technique of the present invention. In FIG. 29A, X is the number of bases that comprise the test site. Oligonucleotides are identified as SEQ ID NOs: 630–632 (29A), SEQ ID NO: 633 (29B), SEQ ID NO: 634 (29C) and SEQ ID NO: 635 (29D).

FIG. 30 illustrates a sample test oligonucleotide for use in the assay of the present invention, where the test oligonucleotide employs several different DNA:protein interaction systems. Illustrated oligonucleotides are identified as SEQ ID NOs: 636–640.

FIG. 31 illustrates the results of screening a selected test sequence with a single DNA:protein interaction system. In the figure, the test site is shown in bold, the potential binding site for the test molecule is underlined. Test sequences are identified as SEQ ID NO: 659 to SEQ ID NO: 661.

FIG. 32 illustrates the results of screening the same selected test sequence as shown in FIG. 31, but using a different single DNA:protein interaction system. In the figure, the test site is shown in bold, the potential binding site for the test molecule is underlined. Test sequences are identified as SEQ ID NO: 662 to SEQ ID NO: 664.

DETAILED DESCRIPTION OF THE INVENTION

I. Definitions

Figure 1A:
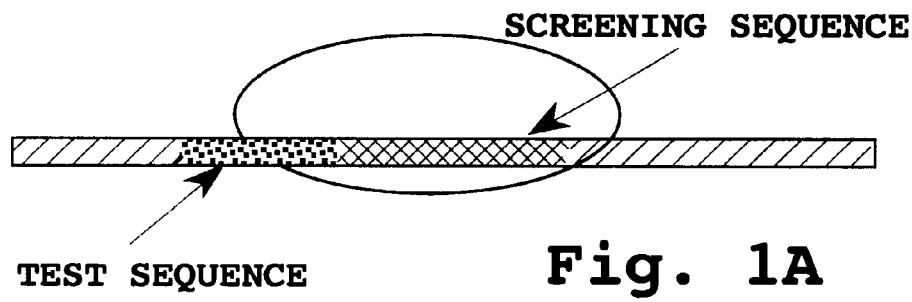
FIG. 1A illustrates a DNA-binding protein binding to a screening sequence.

Adjacent is used to describe the distance relationship between two neighboring sites. Adjacent sites are 20 or less bp apart, and can be separated by any fewer number of bases including the situation where the sites are immediately abutting one another. "Flanking" is a synonym for adjacent.

Bound DNA, as used in this disclosure, refers to the DNA that is bound by the protein used in the assay (e.g., a test oligonucleotide containing the UL9 binding sequence bound to the UL9 protein.

Coding sequences or coding regions are DNA sequences that code for RNA transcripts, unless specified otherwise.

Dissociation is the process by which two molecules cease to interact: the process occurs at a fixed average rate under specific physical conditions.

Functional binding is the noncovalent association of a protein or small molecule to the DNA molecule. In one embodiment of the assay of the present invention the functional binding of the UL9 protein to a screening sequence (i.e., its cognate DNA binding site) has been evaluated using filter binding or gel band-shift experiments.

Half-life is herein defined as the time required for one-half of the associated complexes, e.g., DNA:protein complexes, to dissociate.

Heteropolymers are molecules comprised of at least two different subunits, each representing a different type or class of molecule. The covalent coupling of different subunits, such as, DNA-binding molecules or portions of DNA-binding molecules, results in the formation of a heteropolymer: for example, the coupling of a non-intercalating homopolymeric DNA-binding molecule, such as distamycin, to an intercalating drug, such as daunomycin. Likewise, the coupling of netropsin, which is essentially a molecular subunit of distamycin, to daunomycin would also be a heteropolymer. As a further example, the coupling of distamycin, netropsin, or daunomycin to a DNA-binding homopolymer, such as a triplex-forming oligonucleotide, would result in a heteropolymer.

Homopolymers are molecules that are comprised of a repeating subunit of the same type or class. Two examples of duplex DNA-binding homopolymers are as follows: (i) triplex-forming oligonucleotides or oligonucleotide analogs, which are composed of repeating subunits of nucleotides or nucleotide analogs, and (ii) oligopeptides, which are composed of repeating subunits linked by peptide bonds (e.g., distamycin, netropsin).

Sequence-preferential binding refers to DNA binding molecules that generally bind DNA but that show preference for binding to some DNA sequences over others. Sequence-preferential binding is typified by several of the small molecules tested in the present disclosure, e.g., distamycin. Sequence-preferential and sequence-specific binding can be evaluated using a test matrix such as is presented in FIG. 12. For a given DNA-binding molecule, there are a spectrum of differential affinities for different DNA sequences ranging from non-sequence-specific (no detectable preference) to sequence preferential to absolute sequence specificity (i.e., the recognition of only a single sequence among all possible sequences, as is the case with many restriction endonucleases).

Sequence-specific binding refers to DNA binding molecules which have a strong DNA sequence binding preference. For example, the following demonstrate typical sequence-specific DNA-binding: (i) multimers (heteropolymers and homopolymers) of the present invention (e.g., Section IV.E.1, Multimerization; Example 13), and (ii) restriction enzymes and the proteins listed in Table IV.

Screening sequence is the DNA sequence that defines the cognate binding site for the DNA binding protein: in the case of UL9, the screening sequence can, for example, be SEQ ID NO:601.

Small molecules are desirable as therapeutics for several reasons related to drug delivery, including the following: (i) they are commonly less than 10 K molecular weight; (ii) they are more likely to be permeable to cells; (iii) unlike peptides or oligonucleotides, they are less susceptible to degradation by many cellular mechanisms; and, (iv) they are not as apt to elicit an immune response. Many pharmaceutical companies have extensive libraries of chemical and/or biological mixtures, often fungal, bacterial, or algal extracts, that would be desirable to screen with the assay of the present invention. Small molecules may be either biological or synthetic organic compounds, or even inorganic compounds (i.e., cisplatin).

Test sequence is a DNA sequence adjacent the screening sequence. The assay of the present invention screens for molecules that, when bound to the test sequence, affect the interaction of the DNA-binding protein with its cognate binding site (i.e., the screening sequence). Test sequences can be placed adjacent either or both ends of the screening sequence. Typically, binding of molecules to the test sequence interferes with the binding of the DNA-binding protein to the screening sequence. However, some molecules binding to these sequences may have the reverse effect, causing an increased binding affinity of the DNA-binding protein to the screening sequence. Some molecules, even while binding in a sequence specific or sequence preferential manner, might have no effect in the assay. These molecules would not be detected in the assay.

Unbound DNA, as used in this disclosure, refers to the DNA that is not bound by the protein used in the assay (i.e., in the examples of this disclosure, the UL9 protein).

II. The Assay

One feature of the present invention is that it provides an assay to identify small molecules that will bind in a sequence-specific manner to medically significant DNA target sites. The assay facilitates the development of a new field of pharmaceuticals that operates by interfering with specific DNA functions, such as crucial DNA:protein interactions. A sensitive, well-controlled assay has been developed (i) to detect DNA-binding molecules and (ii) to determine their sequence-specificity and affinity. The assay can be used to screen large biological and chemical libraries. For example, the assay will be used to detect sequence-specific DNA-binding molecules in fermentation broths or extracts from various microorganisms.

Furthermore, another application for the assay is to determine the sequence specificity and relative affinities of known DNA-binding drugs (and other DNA-binding molecules) for different DNA sequences. Such drugs, which are currently used primarily as antibiotics or anticancer drugs, may have previously unidentified activities that make them strong candidates for therapeutics or therapeutic precursors in entirely different areas of medicine. The use of the assay to determine the sequence-binding preference of these known DNA-binding molecules enables the rational design of novel DNA-binding molecules with enhanced sequence-binding preference. The methods for designing and testing these novel DNA-binding molecules is described below.

The screening assay of the present invention is basically a competition assay that is designed to test the ability of a test molecule to compete with a DNA-binding protein for binding to a short, synthetic, double-stranded oligodeoxynucleotide that contains the recognition sequence for the DNA-binding protein flanked on either or both sides by a variable test site. The variable test site may contain any DNA sequence that provides a reasonable recognition sequence for a DNA-binding test molecule. Molecules that bind to the test site alter the binding characteristics of the protein in a manner that can be readily detected. The extent to which such molecules are able to alter the binding characteristics of the protein is likely to be directly proportional to the affinity of the test molecule for the DNA test site. The relative affinity of a given molecule for different oligonucleotide sequences at the test site (i.e., test sequences) can be established by examining the molecule's effect on the DNA:protein interaction using each of the test sequences.

The assay can be used to test specific target sequences and to identify novel DNA-binding molecules. Also, the assay provides a means for the determination of the high affinity DNA binding sites for a given DNA-binding molecule, thus facilitating the identification of specific target sequences.

A. General Considerations.

The assay of the present invention has been designed for detecting test molecules or compounds that affect the rate of transfer of a specific DNA molecule from one protein molecule to another identical protein in solution.

A mixture of DNA and protein is prepared in solution. The concentration of protein is in excess to the concentration of the DNA so that virtually all of the DNA is found in DNA:protein complexes. The DNA is a double-stranded oligonucleotide that contains the recognition sequence for a specific DNA-binding protein (i.e., the screening sequence). The protein used in the assay contains a DNA-binding domain that is specific for binding to the sequence within the oligonucleotide. The physical conditions of the solution (e.g., pH, salt concentration, temperature) are adjusted such that the half-life of the complex is amenable to performing the assay (optimally a half-life of 5–120 minutes), preferably in a range that is close to normal physiological conditions.

As one DNA:protein complex dissociates, the released DNA rapidly reforms a complex with another protein in solution. Since the protein is in excess to the DNA, dissociations of one complex always result in the rapid reassociation of the DNA into another DNA:protein complex. At equilibrium, very few DNA molecules will be unbound. If the unbound DNA is the component of the system that is measured, the minimum background of the assay is the amount of unbound DNA observed during any given measurable time period. If the capture/detection system used for capturing the unbound DNA is irreversible, the brevity of the observation period (the length of time used to capture the unbound DNA) and the sensitivity of the detection system define the lower limits of background DNA.

Figure 1B:
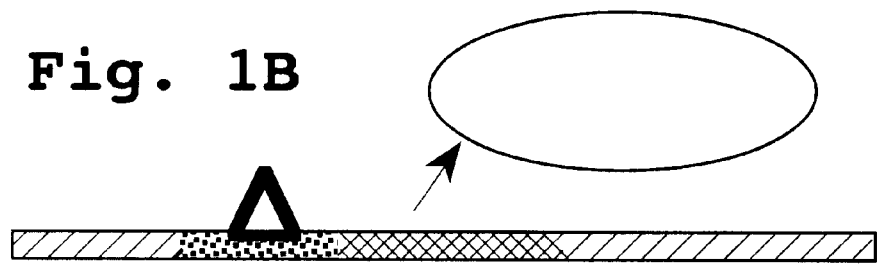
FIGS. 1B and 1C illustrate how a DNA-binding protein may be displaced or hindered in binding by a small molecule by two different mechanisms: because of stearic hinderance (1B) or because of conformational (allosteric) changes induced in the DNA by a small molecule (1C).
Figure 1C:
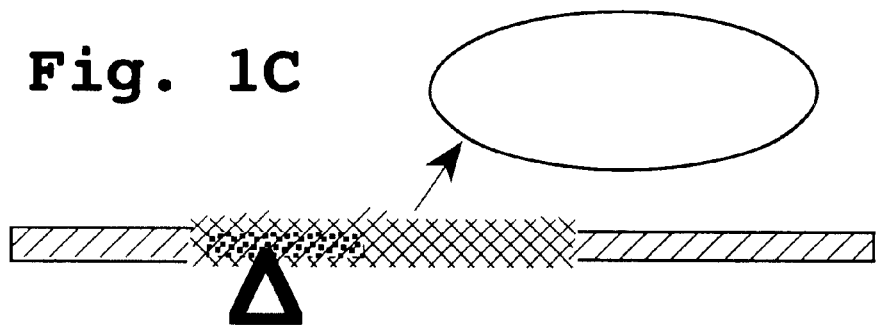

FIG. 1 illustrates how (i) such a protein can be displaced from its cognate binding site, (ii) a protein can be prevented from binding its cognate binding site, and (iii) how the kinetics of the DNA:protein interaction can be altered. In each case, the binding site for the test molecule is located at a site flanking the recognition sequence for the DNA-binding protein (FIG. 1A). One mechanism is stearic hinderance of protein binding by a small molecule (competitive inhibition; FIG. 1B). Alternatively, a molecule may interfere with a DNA:protein binding interaction by inducing a conformational change in the DNA (allosteric interference, noncompetitive inhibition; FIG. 1C). In either event, if a test molecule that binds the oligonucleotide hinders binding of the protein, even transiently, the rate of transfer of DNA from one protein to another will be decreased. This will result in a net increase in the amount of unbound DNA and a net decrease in the amount of protein-bound DNA. In other words, an increase in the amount of unbound DNA or a decrease in the amount of bound DNA indicates the presence of an inhibitor, regardless of the mechanism of inhibition (competitive or noncompetitive).

Alternatively, molecules may be isolated that, when bound to the DNA, cause an increased affinity of the DNA-binding protein for its cognate binding site. In this case, the assay control samples (no drug added) are adjusted to less than 100% DNA:protein complex so that the increase in binding can be detected. The amount of unbound DNA (observed during a given measurable time period after the addition of the molecule) will decrease and the amount of bound DNA will increase in the reaction mixture as detected by the capture/detection system described in Section II.

B. Choosing and Testing an Appropriate DNA-Binding Protein.

Experiments performed in support of the present invention have defined an approach for identifying molecules having sequence-preferential DNA-binding. In this approach small molecules binding to sequences adjacent the cognate binding sequence can inhibit the protein/cognate DNA interaction. This assay has been designed to use a single DNA:protein interaction to screen for sequence-specific or sequence-preferential DNA-binding molecules that recognize virtually any sequence.

While DNA-binding recognition sites are usually quite small (4–17 bp), the sequence that is protected by the binding protein is larger (usually 5 bp or more on either side of the recognition sequence—as detected by DNAase I protection (Galas, et al.) or methylation interference (Siebenlist, et al.).

Experiments performed in support of the present invention demonstrated that a single protein and its cognate DNA-binding sequence can be used to assay virtually any DNA sequence by placing a sequence of interest adjacent to the cognate site: a small molecule bound to the adjacent site can be detected by alterations in the binding characteristics of the protein to its cognate site. Such alterations might occur by either stearic hindrance (which would cause the dissociation of the protein) or induced conformational changes in the recognition sequence for the protein (which may cause either enhanced binding or, more likely, decreased binding of the protein to its cognate site).

1. Criteria for Choosing an Appropriate DNA-Binding Protein.

There are several considerations involved in choosing DNA:protein complexes that can be employed in the assay of the present invention including:

a.) The half-life of the DNA:protein complex should be short enough to accomplish the assay in a reasonable amount of time. The interactions of some proteins with their cognate binding sites in DNA can be measured in days not minutes: such tightly bound complexes would inconveniently lengthen the period of time it takes to perform the assay.

b.) The half-life of the complex should be long enough to allow the measurement of unbound DNA in a reasonable amount of time. For example, the level of free DNA is dictated by the ratio between the time needed to measure free DNA and the amount of free DNA that occurs naturally due to the dissociation of the complex during the measurement time period.

In view of the above two considerations, practical useful DNA:protein half-lives fall in the range of approximately two minutes to several days: shorter half-lives may be accommodated by faster equipment and longer half-lives may be accommodated by destabilizing the binding conditions for the assay.

c.) A further consideration is that the kinetic interactions of the DNA:protein complex is relatively insensitive to the nucleotide sequences flanking the recognition sequence. The affinity of DNA-binding proteins may be affected by differences in the sequences adjacent to the recognition sequence. If the half-life of the complex is affected by the flanking sequence, the analysis of comparative binding data between different flanking oligonucleotide sequences becomes difficult but is not impossible.

2) Testing DNA:Frotein Interactions for Use in the Assay.

a.) Other DNA:Protein Interactions Useful in the Method of the Present Invention.

There are many known DNA:protein interactions that may be useful in the practice of the present invention, including (i) the DNA protein interactions listed in Table IV, (ii) bacterial, yeast, and phage systems such as lambda $o_L$-$o_R$/cro, and (iii) modified restriction enzyme systems (e.g., protein binding in the absence of divalent cations, see Section IV). Any protein that binds to a specific recognition sequence may be useful in the present invention. One constraining factor is the effect of the immediately adjacent sequences (the test sequences) on the affinity of the protein for its recognition sequence. DNA:protein interactions in which there is little or no effect of the test sequences on the affinity of the protein for its cognate site are preferable for use in the described assay; however, DNA:protein interactions that exhibit test-sequence-dependent differential binding may still be useful if algorithms that compensate for the differential affinity are applied to the analysis of data. In general, the effect of flanking sequence composition on the binding of the protein is likely to be correlated to the length of the recognition sequence for the DNA-binding protein. That is, the kinetics of binding for proteins with shorter recognition sequences are more likely to suffer from flanking sequence effects, while the kinetics of binding for proteins with longer recognition sequences are more likely to not be affected by flanking sequence composition. The present disclosure provides methods and guidance for testing the usefulness of such DNA:protein interactions, in the screening assay.

b.) The Use of UL9 Proteins in the Practice of the Present Invention.

Experiments performed in support of the present invention have identified a DNA:protein interaction that is particularly useful for the above described assay: the Herpes Simplex Virus (HSV) UL9 protein that binds the HSV origin of replication (oriS). The UL9 protein has fairly stringent sequence specificity. There appear to be three binding sites for UL9 in oris, SEQ ID NO:601, SEQ ID NO:602 and SEQ ID NO:615 (Elias, et al.; Stow, et al.). One sequence (SEQ ID NO:601) binds with at least 10-fold higher affinity than the second sequence (SEQ ID NO:602): the embodiments described below use the higher affinity binding site (SEQ ID NO:601). Another useful UL9-binding site, alibi a lower affinity binding site, SEQ ID NO:641, has also been identified.

DNA:protein association reactions are performed in solution. The DNA:protein complexes can be separated from free DNA by any of several methods. One particularly useful method for the initial study of DNA:protein interactions has been visualization of binding results using band shift gels (Example 3A). In this method DNA:protein binding reactions are applied to polyacrylamide/TBE gels and the labelled complexes and free labeled DNA are separated electrophoretically. These gels are fixed, dried, and exposed to X-ray film. The resulting autoradiograms are examined for the amount of free probe that is migrating separately from the DNA:protein complex. These assays include (i) a lane containing only free labeled probe, and (ii) a lane where the sample is labeled probe in the presence of a large excess of binding protein. The band shift assays allow visualization of the ratios between DNA:protein complexes and free probe. However, they are less accurate than filter binding assays for rate-determining experiments due to the lag time between loading the gel and electrophoretic separation of the components.

The filter binding method is particularly useful in determining the half-life for oligonucleotide:protein complexes (Example 3B). In the filter binding assay, DNA:protein complexes are retained on a filter while free DNA passes through the filter. This assay method is more accurate for half-life determinations because the separation of DNA:protein complexes from free probe is very rapid. The disadvantage of filter binding is that the nature of the DNA:protein complex cannot be directly visualized. So if, for example, the competing molecule was also a protein competing for the binding of a site on the DNA molecule, filter binding assays cannot differentiate between the binding of the two proteins nor yield information about whether one or both proteins are binding.

c. Preparation of Full Length UL9 and UL9-COOH Polypeptides.

Figure 8:
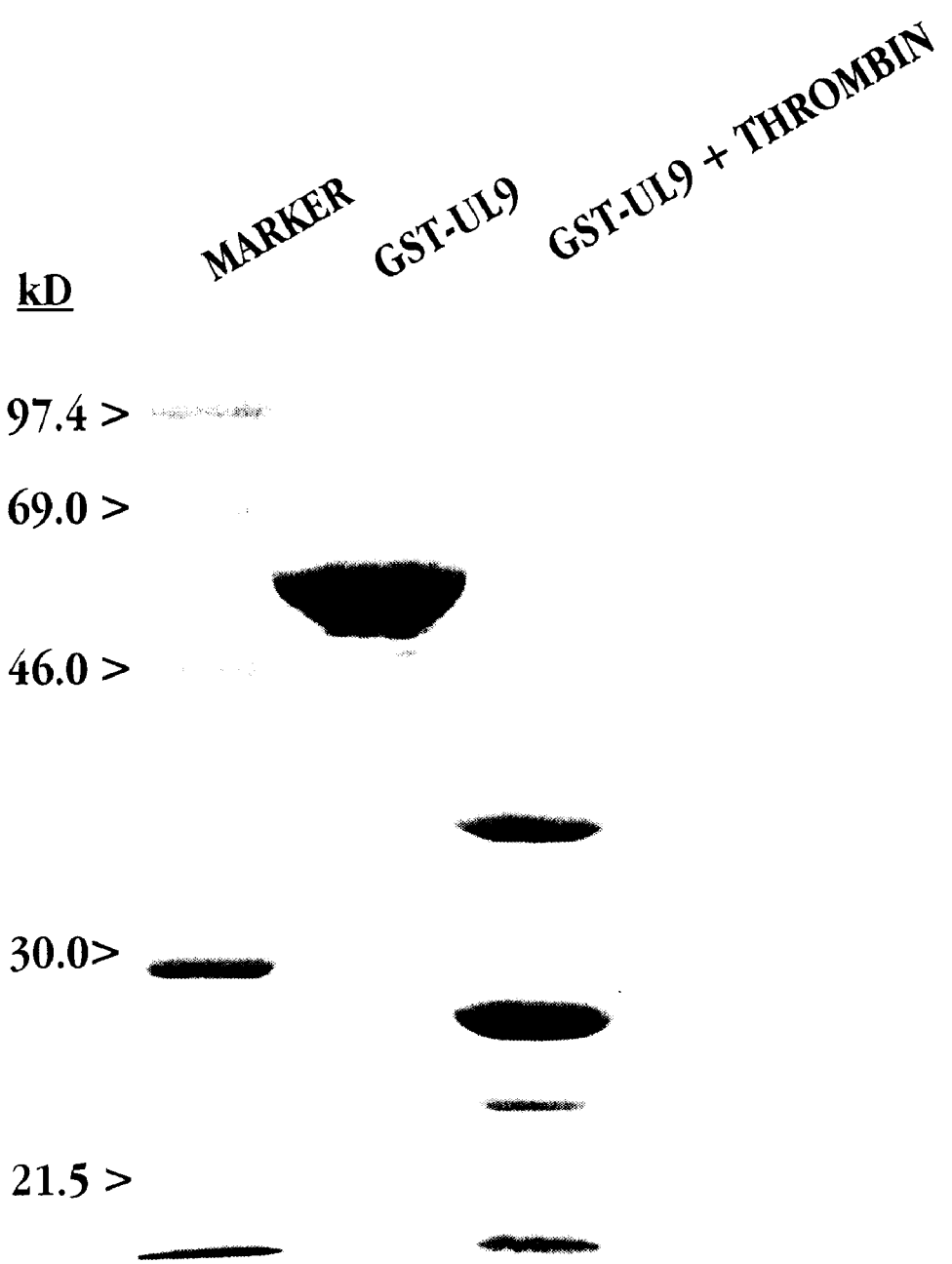
FIG. 8 is a photograph of a SDS-polyacrylamide gel showing (i) the purified UL9-COOH/glutathione-S-transferase fusion protein and (ii) the UL9-COOH polypeptide.

UL9 protein has been prepared by a number of recombinant techniques (Example 2). The full length UL9 protein has been prepared from baculovirus infected insect cultures (Example 3A, B, and C). Further, a portion of the UL9 protein that contains the DNA-binding domain (UL9-COOH) has been cloned into a bacterial expression vector and produced by bacterial cells (Example 3D and E). The DNA-binding domain of UL9 is contained within the C-terminal 317 amino acids of the protein (Weir, et al.). The UL9-COOH polypeptide was inserted into the expression vector in-frame with the glutathione-S-transferase (gst) protein. The gst/UL9 fusion protein was purified using affinity chromatography (Example 3E). The vector also contained a thrombin cleavage site at the junction of the two polypeptides. Therefore, once the fusion protein was isolated (FIG. 8, lane 2) it was treated with thrombin, cleaving the UL9-COOH/gst fusion protein from the gst polypeptide (FIG. 8, lane 3). The UL9-COOH-gst fusion polypeptide was obtained at a protein purity of greater than 95% as determined using Coomassie staining.

Other hybrid proteins can be utilized to prepare DNA-binding proteins of interest. For example, fusing a DNA-binding protein coding sequence in-frame with a sequence encoding the thrombin site and also in-frame with the β-galactoside coding sequence. Such hybrid proteins can be isolated by affinity or immunoaffinity columns (Maniatis, et al.; Pierce, Rockford Ill.). Further, DNA-binding proteins can be isolated by affinity chromatography based on their ability to interact with their cognate DNA binding site. For example, the UL9 DNA-binding site (SEQ ID NO:601) can be covalently linked to a solid support (e.g., CnBr-activated Sepharose 4B beads, Pharmacia, Piscataway N.J.), extracts passed over the support, the support washed, and the DNA-binding then isolated from the support with a salt gradient (Kadonaga). Alternatively, other expression systems in bacteria, yeast, insect cells or mammalian cells can be used to express adequate levels of a DNA-binding protein for use in this assay.

The results presented below in regard to the DNA-binding ability of the truncated UL9 protein suggest that full length DNA-binding proteins are not required for the DNA:protein assay of the present invention: only a portion of the protein containing the cognate site recognition function may be required. The portion of a DNA-binding protein required for DNA-binding can be evaluated using a functional binding assay (Example 4A). The rate of dissociation can be evaluated (Example 4B) and compared to that of the full length DNA-binding protein. However, any DNA-binding peptide, truncated or full length, may be used in the assay if it meets the criteria outlined in Section II.B.1, "Criteria for choosing an appropriate DNA-binding protein". This remains true whether or not the truncated form of the DNA-binding protein has the same affinity as the full length DNA-binding protein.

d. Functional Binding and Rate of Dissociation.

The full length UL9 and purified UL9-COOH proteins were tested for functional activity in "band shift" assays (see Example 4A). The buffer conditions were optimized for DNA:protein-binding (Example 4C) using the UL9-COOH polypeptide. These DNA-binding conditions also worked well for the full-length UL9 protein. Radiolabeled oligonucleotides (SEQ ID NO:614) that contained the 11 bp UL9 DNA-binding recognition sequence (SEQ ID NO:601) were mixed with each UL9 protein in appropriate binding buffer. The reactions were incubated at room temperature for 10 minutes (binding occurs in less than 2 minutes) and the products were separated electrophoretically on non-denaturing polyacrylamide gels (Example 4A).

The degree of DNA:protein-binding could be determined from the ratio of labeled probe present in DNA:protein complexes versus that present as free probe. This ratio was typically determined by optical scanning of autoradiograms and comparison of band intensities. Other standard methods may be used as well for this determination, such as scintillation counting of excised bands. The UL9-COOH polypeptide and the full length UL9 polypeptide, in their respective buffer conditions, bound the target oligonucleotide equally well.

The rate of dissociation was determined using competition assays. An excess of unlabelled oligonucleotide that contained the UL9 binding site was added to each reaction. This unlabelled oligonucleotide acts as a specific inhibitor, capturing the UL9 protein as it dissociates from the labelled oligonucleotide (Example 4B). The dissociation rate, as determined by a band-shift assay, for both full length UL9 and UL9-COOH was approximately 4 hours at 4° C. or approximately 10 minutes at room temperature. Neither non-specific oligonucleotides (a 10,000-fold excess) nor sheared herring sperm DNA (a 100,000-fold excess) competed for binding with the oligonucleotide containing the UL9 binding site.

e. oriS Flanking Sequence Variation.

As mentioned above, one feature of a DNA:protein-binding system to be used in the assay of the present invention is that the DNA:protein interaction is not affected by the nucleotide sequence of the regions adjacent the DNA-binding site. The sensitivity of any DNA:protein-binding reaction to the composition of the flanking sequences can be evaluated by the functional binding assay and dissociation assay described above.

To test the effect of flanking sequence variation on UL9 binding to the oriS SEQ ID NO: 601 sequences oligonucleotides were constructed with 20–30 different sequences (i.e., the test sequences) flanking the 5' and 3' sides of the UL9 binding site. Further, oligonucleotides were constructed with point mutations at several positions within the UL9 binding site. Most point mutations within the binding site destroyed recognition. Several changes did not destroy recognition and these include variations at sites that differ between the UL9 binding sites (SEQ ID NO:601, SEQ ID NO:602, SEQ ID NO:615 and SEQ ID NO:641): the second UL9 binding site (SEQ ID NO:602) shows a ten-fold decrease in UL9:DNA binding affinity (Elias, et al.) relative to the first (SEQ ID NO:601). On the other hand, sequence variation at the test site (also called the test sequence, adjacent to the screening site (FIG. 5, Example 5), had virtually no effect on binding or the rate of dissociation.

The results demonstrating that the nucleotide sequence in the test site, which flanks the screening site, has no effect on the kinetics of UL9 binding in any of the oligonucleotides tested is a striking result. This allows the direct comparison of the effect of a DNA-binding molecule on test oligonucleotides that contain different test sequences. Since the only difference between test oligonucleotides is the difference in nucleotide sequence at the test site(s), and since the nucleotide sequence at the test site has no effect on UL9 binding, any differential effect observed between the two test oligonucleotides in response to a DNA-binding molecule must be due solely to the differential interaction of the DNA-binding molecule with the test sequence(s). In this manner, the insensitivity of UL9 to the test sequences flanking the UL9 binding site greatly facilitates the interpretation of results. Each test oligonucleotide acts as a control sample for all other test oligonucleotides. This is particularly true when ordered sets of test sequences are tested (e.g., testing all 256 four base pair sequences (FIG. 13) for binding to a single drug).

Taken together the above experiments support that the UL9-COOH polypeptide binds the SEQ ID NO:601 sequence with (i) appropriate strength, (ii) an acceptable dissociation time, and (iii) indifference to the nucleotide sequences flanking the screening site. These features suggested that the UL9/oriS system could provide a versatile assay for detection of small molecule/DNA-binding involving any number of specific nucleotide sequences.

The above-described experiment can be used to screen other DNA:protein interactions to determine their usefulness in the present assay.

f. Small Molecules as Sequence-Specific Competitive Inhibitors.

To test the utility of the present assay system several small molecules that have sequence-binding preferences (i.e., a preference for AT-rich versus GC-rich sequences) have been tested.

Distamycin A binds relatively weakly to DNA ($K_A=2\times10^5$ $M^{-1}$) with a preference for non-alternating AT-rich sequences (Jain, et al.; Sobell; Sobell, et al.). Actinomycin D binds DNA more strongly ($K_A=7.6\times10^{-7}$ $M^{-1}$) than Distamycin A and has been reported to have a relatively strong preference for the dinucleotide sequence dGdC (Luck, et al.; Zimmer; Wartel). Each of these molecules poses a stringent test for the assay. Distamycin A tests the sensitivity of the assay because of its relatively weak binding. Actinomycin D challenges the ability to utilize flanking sequences since the UL9 recognition sequence contains a dGdC dinucleotide: therefore, it might be anticipated that all of the oligonucleotides, regardless of the test sequence flanking the assay site, might be equally affected by actinomycin D.

In addition, Doxorubicin, a known anti-cancer agent that binds DNA in a sequence-preferential manner (Chen, K-X, et al.), has been tested for preferential DNA sequence binding using the assay of the present invention.

Actinomycin D, Distamycin A, and Doxorubicin have been tested for their ability to preferentially inhibit the binding of UL9 to oligonucleotides containing different sequences flanking the UL9 binding site (Example 6, FIG. 5). Furthermore, distamycin A and actinomycin D have been screened against all possible 256 4 bp DNA sequences. Binding assays were performed as described in Example 5. These studies were completed under conditions in which UL9 is in excess of the DNA (i.e., most of the DNA is in DNA:protein complexes).

In the preliminary studies, distamycin A was tested with 5 different test sequences flanking the UL9 screening sequence: SEQ ID NO:605 to SEQ ID NO:609. The results shown in FIG. 10A demonstrate that Distamycin A preferentially disrupts binding to the test sequences UL9 polyT, UL9 polyA and, to a lesser extent, UL9ATAT. FIG. 10A also shows the concentration dependence of the inhibitory effect of distamycin A: at 1 $\mu$M distamycin A most of the DNA:protein complexes are intact (top band) with free probe appearing in the UL9 polyT and UL9 polyA lanes, and some free probe appearing in the UL9 ATAT lane; at 4 $\mu$M free probe can be seen in the UL9 polyT and UL9 polyA lanes; at 16 $\mu$M free probe can be seen in the UL9 polyT and UL9 polyA lanes; and at 40 $\mu$M the DNA:protein in the polyT, UL9 polyA and UL9 ATAT lanes are near completely disrupted while some DNA:protein complexes in the other lanes persist. These results were consistent with the reported preference of Distamycin A for non-alternating AT-rich sequences.

Actinomycin D was tested with 8 different test sequences flanking the UL9 screening sequence: SEQ ID NO:605 to SEQ ID NO:609, and SEQ ID NO:611 to SEQ ID NO:613. The results shown in FIG. 10B demonstrate that actinomycin D preferentially disrupts the binding of UL9-COOH to the oligonucleotides UL9 CCCG (SEQ ID NO:605) and UL9 GGGC (SEQ ID NO:606). These oligonucleotides contain, respectively, three or five dGdC dinucleotides in addition to the dGdC dinucleotide within the UL9 recognition sequence. This result is consistent with the results described in the literature for Actinomycin D binding to the dinucleotide sequence dGdC. Apparently the presence of a potential preferred target site within the screening sequence (oriS, SEQ ID NO:601), as mentioned above, does not interfere with the function of the assay.

Figure 10B:
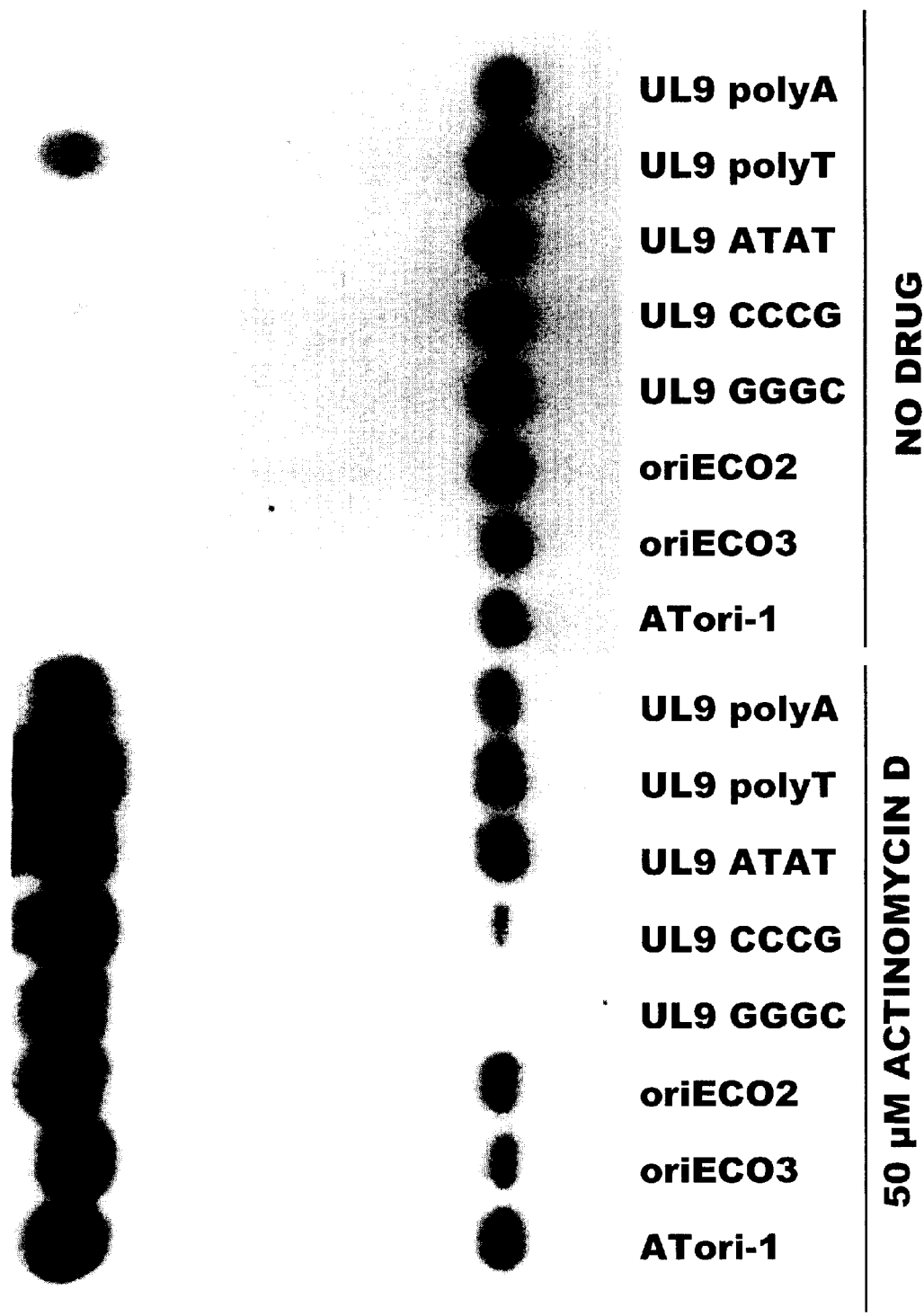
FIG. 10B shows the effect of the addition of actinomycin D to DNA:protein assay reactions utilizing different test sequences.
Figure 10C:
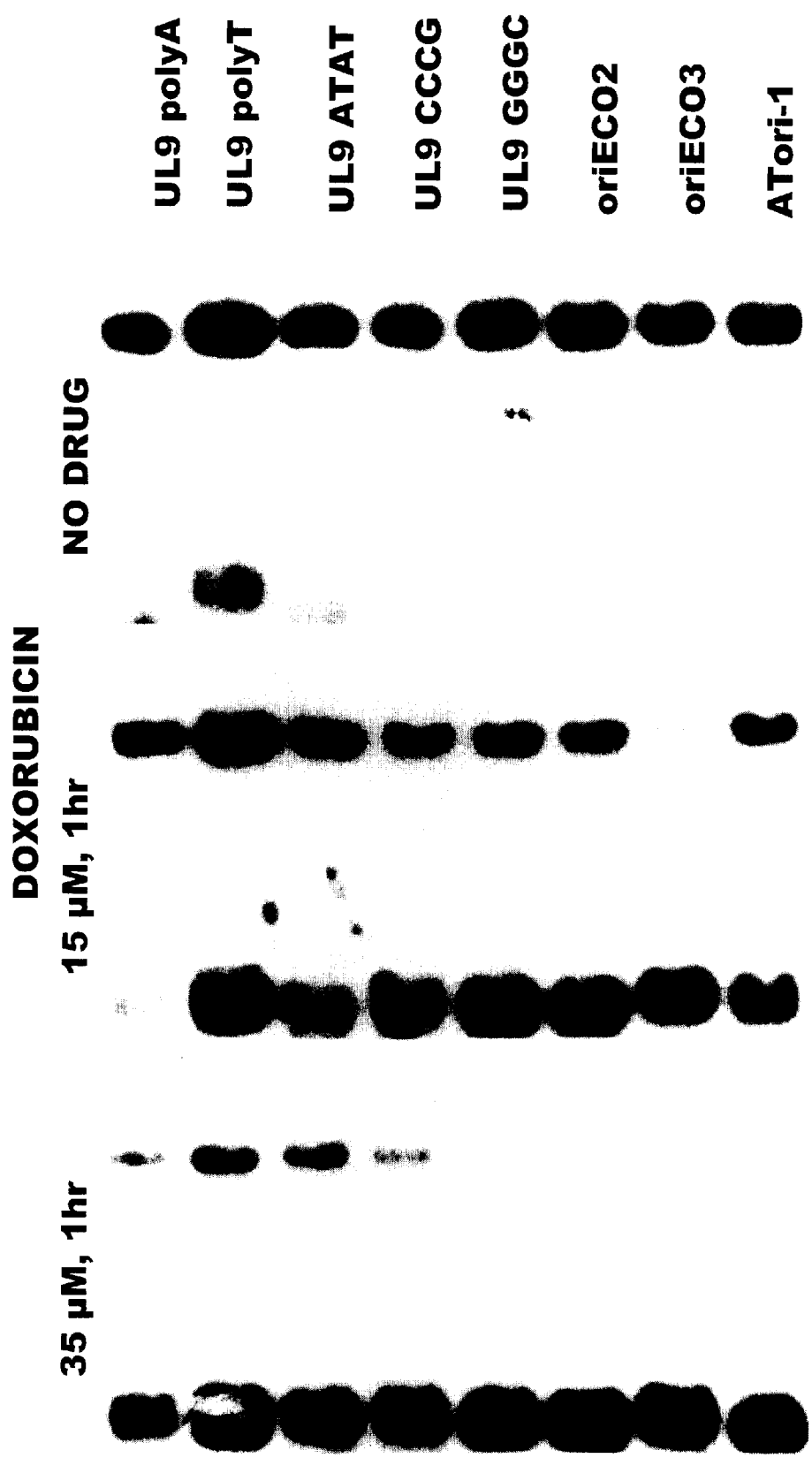
FIG. 10C shows the effect of the addition of Doxorubicin to DNA:protein assay reactions utilizing different test sequences.

Doxorubicin was tested with 8 different test sequences flanking the UL9 screening sequence: SEQ ID NO:605 to SEQ ID NO:609, and SEQ ID NO:611 to SEQ ID NO:613. The results shown in FIG. 10C demonstrate that Doxorubicin preferentially disrupts binding to oriEco3, the test sequence of which differs from oriEco2 by only one base (compare SEQ ID NO:612 and SEQ ID NO:613). FIG. 10C also shows the concentration dependence of the inhibitory effect of Doxorubicin: at 15 $\mu$M Doxorubicin, the UL9 binding to the screening sequence is strongly affected when oriEco3 is the test sequence, and more mildly affected when polyT, UL9 GGGC, or oriEco2 was the test sequence; and at 35 $\mu$M Doxorubicin most DNA:protein complexes are nearly completely disrupted, with UL9 polyT and UL9ATAT showing some DNA still complexed with protein. Also, effects similar to those observed at 15 $\mu$M were also observed using Doxorubicin at 150 nM, but at a later time point.

The feasibility studies performed with the limited set of test sequences, described above, provided evidence that the results of the assay are not inconsistent with the results reported in the literature. However, the screening of all possible 256 four base-pair sequences, using the assay of the present invention, provides a much more extensive overview of the sequence preferences of distamycin A and actinomycin D.

The actual ranking of values obtained from the assay, for any given test compound, can be variable. A number of sequences can be clustered having similar affinity: although absolute rank might not be determinable, relative ranks can be determined.

The results obtained in the feasibility studies with both distamycin A and actinomycin D were corroborated by the results obtained in the screen of all 256 sequences. In other words, the rank of the oligonucleotides remained internally consistent in the larger screen. Further, the screens of distamycin A and actinomycin D both support the general hypotheses described in the literature: that is, distamycin A has a preference for binding AT-rich sequences while actinomycin D has a preference for binding GC-rich sequences. However, both drug screens of all possible 4 bp sequences revealed additional characteristics that have not been described in the literature.

Figure 16:
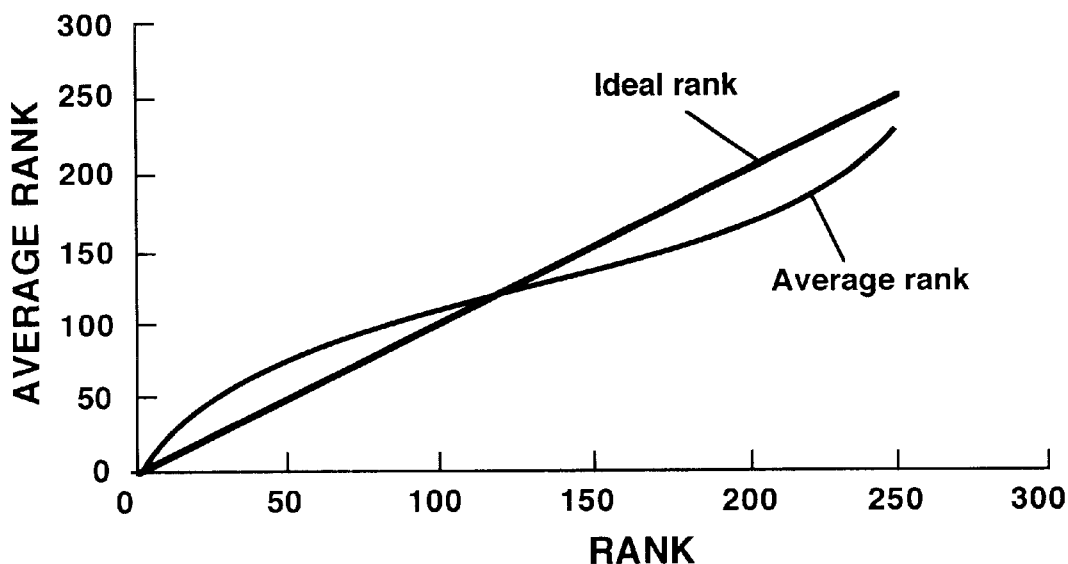
FIG. 16 shows the average ranks (FIG. 15) plotted against the ideal ranks 1 to 256.
Figure 17:
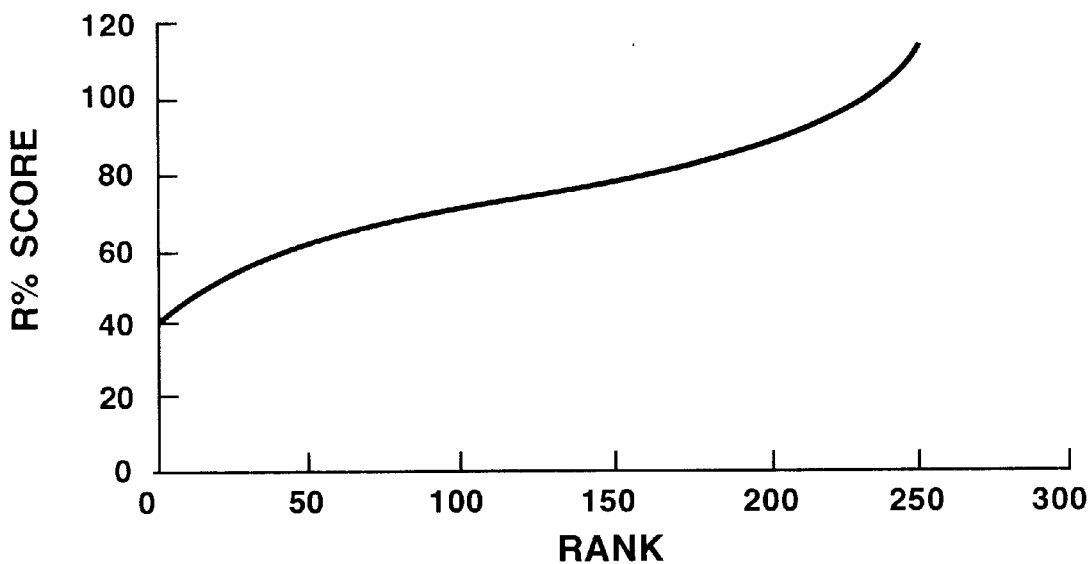
FIG. 17 shows the average r % scores (FIG. 15) plotted against the rank of 1 to 256.

Based on the data from 4 separate experiments (Examples 10 and 11; FIGS. 15, 16 and 17), consensus sequences can be derived for distamycin binding. One consensus sequence (Example 11) is relatively AT-rich, although the preference in the 4th base position is distinctly G or C. The other consensus sequence (Example 11) is relatively GC-rich, with some of the sequences having a 75% GC-content. As noted above, the assay data is consistent with distamycin binding data shown in the literature.

The ability of the assay to distinguish sequence binding preference using weak DNA-binding molecules with relatively poor sequence-specificity (such as distamycin A) is a stringent test of the assay. Accordingly, the present assay seems well-suited for the identification of molecules having better sequence specificity and/or higher sequence binding affinity. Further, the results demonstrate sequence preferential binding with the known anti-cancer drug Doxorubicin. This result indicates the assay may be useful for screening mixtures for molecules displaying similar characteristics that could be subsequently tested for anti-cancer activities as well as sequence-specific binding.

Other compounds that may be suitable for testing in the present DNA:protein system or for defining alternate DNA:protein systems include the following categories of DNA-binding molecules.

A first category of DNA-binding molecules includes non-intercalating major and minor groove DNA-binding molecules. For example, two major classes of major groove binding molecules are DNA-binding proteins (or peptides) and nucleic acids (or nucleic acid analogs such as those with peptide or morpholino backbones) capable of forming triplex DNA. There are a number of non-intercalating minor groove DNA-binding molecules including, but not limited to the following: distamycin A, netropsin, mithramycin, chromomycin and oligomycin, which are used as antitumor agents and antibiotics; and synthetic antitumor agents such as berenil, phthalanilides, aromatic bisguanylhydrazones and bisquaternary ammonium heterocycles (for review, see Baguley, 1982). Non-intercalating DNA-binding molecules vary greatly in structure: for example, the netropsin-distamycin series are oligopeptides compared to the diarylamidines berenil and stilbamidine.

A second category of DNA-binding molecules includes intercalating DNA-binding molecules. Intercalating agents are an entirely different class of DNA-binding molecules that have been identified as antitumor therapeutics and include molecules such as daunomycin (Chaires, et al.) and nogalomycin (Fox, et al., 1988) (see Remers, 1984).

A third category of DNA-binding molecules includes molecules that have both groove-binding and intercalating properties. DNA-binding molecules that have both intercalating and minor groove binding properties include actinomycin D (Goodisman, et al.), echinomycin (Fox, et al. 1990), triostin A (Wang, et al.), and luzopeptin (Fox, 1988). In general, these molecules have one or two planar polycyclic moieties and one or two cyclic oligopeptides. Luzopeptins, for instance, contain two substituted quinoline chromophores linked by a cyclic decadepsipeptide. They are closely related to the quinoxaline family, which includes echinomycin and triostin A, although they luzopeptins have ten amino acids in the cyclic peptide, while the quinoxaline family members have eight amino acids.

In addition to the major classes of DNA-binding molecules, there are also some small inorganic molecules, such as cobalt hexamine, which is known to induce Z-DNA formation in regions that contain repetitive GC sequences (Gessner, et al.). Another example is cisplatin, cisdiamminedichloroplatinum(II), which is a widely used anticancer therapeutic. Cisplatin forms a covalent intrastrand crosslink between the N7 atoms of adjacent guanosines (Rice, et al.).

Furthermore, there are a few molecules, such as calichemicin, that have unusual biochemical structures that do not fall in any of the major categories. Calichemicin is an antitumor antibiotic that cleaves DNA and is thought to recognize DNA sequences through carbohydrate moieties (Hawley, et al.). Several DNA-binding molecules, such as daunomycin, A447C, and cosmomycin B have sugar group, which may play a role in the recognition process.

Limited sequence preferences for some of the above drugs have been suggested: for example, echinomycin is thought to preferentially bind to the sequence (A/T)CGT (Fox, et al.). However, the absolute sequence preferences of the known DNA-binding drugs have never been demonstrated. Despite the large number of publications in this field, prior to the development of the assay described herein, no methods were available for determining sequence preferences among all possible binding sequences.

g. Theoretical Considerations on the Concentration of Assay Components.

There are two major components in the assay, the test oligonucleotide (i.e., the test sequence) and the DNA-binding domain of UL9, which is described below. A number of theoretical considerations have been employed in establishing the assay system. In one embodiment of the invention, the assay is used as a mass-screening assay: in this embodiment the smallest volumes and concentrations possible were desirable. Each assay typically uses about 0.1–0.5 ng DNA in a 15–20 $\mu l$ reaction volume (approximately 0.3–1.5 nM). The protein concentration is in excess and can be varied to increase or decrease the sensitivity of the assay. In the simplest scenario (stearic hindrance), where the small molecule is acting as a competitive inhibitor and the ratio of DNA:protein and DNA-binding test molecule:DNA is 1:1, the system kinetics can be described by the following equations:

$$D+P \rightleftharpoons D:P, \text{ where } k_{fp}/k_{bp}=K_{eq,p}=[D:P]/[D][P]$$

and $$D+X \rightleftharpoons D:X, \text{ where } k_{fx}/k_{bx}=K_{eq,x}=[D:X]/[D][X]$$

D=DNA, P=protein, X=DNA-binding molecule, $k_{fp}$ and $k_{fx}$ are the rates of the forward reaction for the DNA:protein interaction and DNA:drug interaction, respectively, and $k_{bp}$ and $k_{bx}$ are the rates of the backwards reactions for the respective interactions. Brackets, [ ], indicate molar concentration of the components.

In the assay, both the protein, P, and the DNA-binding molecule or drug, X, are competing for the DNA. If stearic hindrance is the mechanism of inhibition, the assumption can be made that the two molecules are competing for the same site. When the concentration of DNA equals the concentration of the DNA:drug or DNA:protein complex, the equilibrium binding constant, $K_{eq}$, is equal to the reciprocal of the protein concentration (1/[P]). When all three components are mixed together, the relationship between the drug and the protein can be described as:

$$K_{eq,p} = z(K_{eq,x})$$

where "z" defines the difference in affinity for the DNA between P and X. For example, if z=4, then the affinity of the drug is 4-fold lower than the affinity of the protein for the DNA molecule. The concentration of X, therefore, must be 4-fold greater than the concentration of P, to compete equally for the DNA molecule. Thus, the equilibrium affinity constant of UL9 will define the minimum level of detection with respect to the concentration and/or affinity of the drug. Low affinity DNA-binding molecules will be detected only at high concentrations; likewise, high affinity molecules can be detected at relatively low concentrations. With certain test sequences, complete inhibition of UL9 binding at markedly lower concentrations than indicated by these analyses have been observed, probably indicating that certain sites among those chosen for feasibility studies have affinities higher than previously published. Note that relatively high concentrations of known drugs can be utilized for testing sequence specificity. In addition, the binding constant of UL9 can be readily lowered by altering the pH or salt concentration in the assay if it ever becomes desirable to screen for molecules that are found at low concentration (e.g., in a fermentation broth or extract).

The system kinetic analysis becomes more complex if more than one protein or drug molecule is bound by each DNA molecule. As an example, if UL9 binds as a dimer, $$D + 2P \leftrightarrows DP_2$$

then the affinity constant becomes dependent on the square of the protein concentration:

$$K = [DP_2]/[D][P]^2$$

The same reasoning holds true for the DNA-binding test molecule, X; if, $$D + 2X \leftrightarrows DX_2$$

then the affinity constant becomes dependent on the square of the protein concentration:

$$K = [DX_2]/[D][X]^2$$

Similarly, if the molar ratio of DNA to DNA-binding test molecule was 1:3, the affinity constant would be dependent on the cube of the drug concentration.

Experimentally, the ratio of molar components can be determined. Given the chemical equation:

$$xD + yP \leftrightarrows D_xP_y,$$

the affinity constant may be described as $$K = [D_xP_y]/[D]^x[P]^y$$

where [ ] indicates concentration, D=DNA, P=protein, x=number of DNA molecules per DNA:protein complex, and y=number of protein molecules per DNA:protein complex. By determining the ratio of DNA:protein complex to free DNA, one can solve for x and y:

if $x_{total} = x_{free} + x_{bound}$;

if a=the fraction of DNA that is free, then the fraction of DNA that is bound can be described as 1-a; and if $x_{bound}$:$x_{free}$ (the ratio of DNA:protein complex to free DNA) is known for more than one DNA concentration. This is because the affinity constant should not vary at different DNA concentrations. Therefore, $$K_{D:P, [D1]} = K_{D:P, [D2]}.$$

Substituting the right side of the equation above, $$[D1_xP_y]/[D1]^x[P]^y = [D2_xP_y]/[D2]^x[P]^y.$$

Because the concentration of components in the assay can be varied and are known, the molar ratio of the components can be determined. Therefore, $[D1_xP_y]$ and $[D2_xP_y]$ can be described as $(1-a_1)[x_1]$ and $(1-a_2)[x_2]$, respectively, and [D1] and [D2] can be described as $(a_1)[x_1]$ and $(a_2)[x_2]$, respectively. [P] remains constant and is described as (y)-(y/x) (1-a) (x), where y is the total protein concentration and (y/x)(1-a)(x) is the protein complexed with DNA.

The system kinetic: analyses become more complex if the inhibition is allosteric (non-competitive inhibition) rather than competition by stearic hindrance. Nonetheless, the probability that the relative effect of an inhibitor on different test sequences is due to its relative and differential affinity to the different test sequences is fairly high. This is particularly true in the assays in which all sequences within an ordered set (e.g., possible sequences of a given length or all possible variations of a certain base composition and defined length) are tested. In short, if the effect of inhibition in the assay is particularly strong for a single sequence, then it is likely that the inhibitor binds that particular sequence with higher affinity than any of the other sequences. Furthermore, while it may be difficult to determine the absolute affinity of the inhibitor, the relative affinities have a high probability of being reasonably accurate. This information will be most useful in facilitating, for instance, the refinement of molecular modeling systems.

h. The Use of the Assay under Conditions of Very High Protein Concentration.

When the screening protein is added to the assay system at very high concentrations (i.e., high enough to force binding to non-specific sites—the protein binds to non-specific sites on the oligonucleotide as well as the screening sequence). This has been demonstrated using band shift gels: when serial dilutions are made of the protein and mixed with a fixed concentration of oligonucleotide, no binding (as seen by a band shift) is observed at very low dilutions (e.g., 1:100,000), a single band shift is observed at moderate dilutions (e.g., 1:100) and a smear, migrating higher than the single band observed at moderate dilutions, is observed at high concentrations of protein (e.g., 1:10). The observation of a smear is indicative of a mixed population of complexes, all of which presumably have the screening protein binding to the screening sequence with high affinity, but in addition have a larger number of proteins bound with markedly lower affinity to other sites.

Some of the low affinity binding proteins are likely bound to the test sequence. For example, when using the UL9-based system, the low affinity binding proteins are likely UL9 or less likely glutathione-S-transferase: these are the only proteins in the assay mixture. These proteins are significantly more sensitive to interference by a molecule binding to the test sequence for two reasons. First, the interference is likely to be by direct stearic hinderance and does not rely on induced conformational changes in the DNA; secondly, the protein is a low affinity binding protein because the test site is not a cognate-binding sequence. In the case of UL9, the difference in affinity between the low affinity binding and the high affinity binding appears to be at least two orders of magnitude.

The filter binding assays capture more DNA:protein complexes when more protein is bound to the DNA. The relative results are accurate, but under moderate protein concentrations, not all of the bound DNA (as demonstrated by band shift assays) will bind to the filter unless there is more than one DNA:protein complex per oligonucleotide (e.g., in the case of UL9, more than one UL9:DNA complex). This makes the assay exquisitely sensitive under conditions of high protein concentration. For instance, when actinomycin binds DNA at a test site under conditions where there is one DNA:UL9 complex per oligonucleotide, a preference for binding GC-rich oligonucleotides has been observed; under conditions of high protein concentration, where more than one DNA:UL9 complex is found per oligonucleotide, this binding preference is even more apparent. These results suggest that the effect of actinomycin D on a test site that is weakly bound by protein may be more readily detected than the effect of actinomycin D on the adjacent screening sequence. Therefore, employing high protein concentrations may increase the sensitivity of the assay.

III. Amplification-Based Selection Technique to Determine the Sequence Preferences of DNA-Binding Molecules A. Design of Test Oligonucleotides.

The above-described assay can be coupled to amplification methods (in one embodiment, polymerase chain reaction (Mullis, et al.; Mullis; Innis, et al.)) to achieve identification of the sequences to which binding of a test molecule is most preferred.

In this embodiment of the present invention, a double stranded test oligonucleotide is synthesized that contains the following elements:

(i) the binding site for a DNA-binding protein (for example, UL9), i.e., the screening site, (ii) adjacent the screening site, a test site composed of more than two base pairs and preferably less than 20 base pairs (most preferably 4–12 bases), and (iii) means to isolate selected sequences for amplification, such as a sufficient number of bases flanking the test site sequences to function as priming sites for polymerase chain reaction amplification or restriction sites useful to facilitate cloning.

Priming sites can also be used as primer binding sites for dideoxy sequencing reactions and may contain restriction endonuclease cleavage sites to facilitate cloning manipulations.

The double-stranded test oligonucleotide can be generated by secondstrand synthesis using a primer complementary to the priming site at the 3' end of the top-strand of the test oligonucleotide. Alternatively, both strands can be generated by other means, such as chemical synthesis, and the double-stranded test oligonucleotides can be generated by hybridization of the strands.

An example of one such a test oligonucleotide is shown in FIG. 29A (SEQ ID NO:630, SEQ ID NO:631 and SEQ ID NO:632). A specific example of a test oligonucleotide is shown in FIG. 29B (SEQ ID NO:633), where X=4. All possible 256 four base pair sequences are represented at equimolar levels within the pool of oligonucleotides generated by this sequence design.

Another example of such a test oligonucleotide sequence is shown in FIG. 29C (SEQ ID NO:6341), for an 8 base pair test sequence. In this pool of mixed sequences, all possible 8 base pair sequences ($4^8$=65,536) are present in equimolar amounts.

A second set of test oligonucleotides may be constructed in which the test site is placed on the other side of the DNA-binding protein recognition site (e.g., FIG. 29D, SEQ ID NO:635).

For any single-stranded test oligonucleotide pool, the single-stranded molecules are annealed to a primer and the bottom strands are enzymatically synthesized by primer extension reactions. One advantage of using the assay/amplification PCR-cycling embodiment of the present invention is that it is convenient to work with larger test sequences in this embodiment. This protocol is geared to determining the highest affinity binding sequences and is not capable of determining the rank of all test sequences nor of identifying low affinity binding sites: such ranking can be determined by screening individual sequences as described above.

B. Applying the Assay to the Mixed Pools of Test Oligonucleotides.

Using double-stranded test oligonucleotides, such as those just described, the basic assay is performed essentially as described above (Section I): typically without the use of radioactive detection systems. As previously discussed, a number of DNA:protein interactions may be used in this assay system. One example of such a system is the interaction of the DNA-binding domain of UL9 (or UL9-COOH) with its cognate recognition sequence.

In this embodiment of the present invention, UL9-COOH is added to the test oligonucleotide pool (for example, 256 four base pair sequences are represented at equimolar levels within the pool of oligonucleotides described above) in UL9 binding buffer. DNA-binding molecules are tested for the ability to differentially disrupt the binding of the UL9 DNA:protein complex by binding to the test sequence. After the addition of the test molecule or test mixture (e.g., a fermentation broth or fungal extract), the assay mixture is incubated for a desired time, then passed through a nitrocellulose filter. DNA:protein (such as DNA:UL9) complexes are captured on the filter. DNA that is not bound by protein passes through the filter (i.e., the filtrate) (step 1). The volume of the assay is adjusted to accommodate the amount required for the filtering process: that is, taking into consideration the losses incurred during the filtering process.

C. Amplification.

In one embodiment, the DNA present in the filtrate is amplified using the polymerase chain reaction (PCR) technology (Mullis; Mullis, et al.; Perkin Elmer-Cetus). An aliquot of the resulting PCR-amplified material is cycled through the DNA:protein binding assay again (step 2), then PCR-amplified again (step 3). Steps 1–3 are repeated several times using each subsequent filtrate. After each PCR amplification, part of the PCR-amplified material is retained for sequencing analysis. The result of the repeated cyclings through the assay/amplification process is that the test oligonucleotide sequences that are amplified contain test sequences that are preferred binding sites for the test molecules. Through subsequent rounds of assay/amplification, these oligonucleotides are amplified to represent a larger and larger percent of the total population of amplified DNA molecules.

In addition to PCR, the DNA present in the filtrate can be amplified by other methods as well. For example, the DNA present in the filtrate can be cloned into a selected vector (such as, phage vectors, e.g., lambda-based, or standard cloning vectors, e.g., pBR322- or pUC-based). The cloned sequences are then transformed into an appropriate host organism in which the selected vector can replicate (for example, bacteria or yeast). The transformed host organism is cultured with concurrent amplification of the vectors containing the cloned sequences. The vectors are then isolated by standard procedures (Maniatis, et al.; Sambrook, et al.; Ausubel, et al.). Typically, the cloned sequences, originally obtained from the DNA filtrate, are obtained from the vector by restriction endonuclease digestion and size-fractionation (for example, electrophoretic separation of the digestion products followed by electroelution of the cloned sequences of interest) (Ausubel, et al.). These isolated amplified test oligonucleotide sequences can then be recycled through subsequent rounds of assay/amplification as described above.

In another embodiment, the oligonucleotide sequences present in the original DNA filtrate can be isolated, sequenced and amplified by in vitro synthesis of copies of the oligonucleotides.

D. Sequencing of Amplified DNA.

Samples from each cycle are sequenced using, for example, radio-labeled primers and dideoxy sequencing methodologies (Sanger) or the chemical methodologies outlined by Maxam and Gilbert. If the amplified sequences are not sufficiently resolved to obtain a unambiguous sequence information, then the DNA is further purified and sequenced. For example, the DNA is cleaved at the restriction endonuclease sites within the primer sequences and subcloned into a convenient sequencing vector, such as "BLUESCRIPT" (Stratagene, La Jolla, Calif.). The sequencing vectors carrying the amplified inserts are transformed into bacteria. The resulting cloned vectors are isolated and sequenced (in the case of "BLUESCRIPT," using the commercially available primers and protocols).

IV. Modifications of Test Oligonucleotides and other Useful DNA:Protein Interactions One class of DNA:protein interactions that may be useful in the assay of the present invention is the restriction endonuclease:restriction site class of DNA:protein interactions. In the absence of divalent cations, restriction endonucleases bind DNA but have no enzymatic activity (cleavage of DNA does not take place without divalent cations). This allows the assay of the present invention to be performed using a restriction endonuclease with its cognate binding site as the screening sequence. The use of the restriction endonuclease:restriction site interaction as the basis of the present assay is described in greater detail in Section VI.B.4(c).

The test oligonucleotides of the present invention can be modified to contain two different DNA:protein screening systems, i.e., two different screening sequences with their respective cognate binding proteins. In the assay described above, the UL9 screening sequence lies on one side of and immediately adjacent to the test sequence. A second screening sequence, such as, a restriction endonuclease recognition sequence (restriction site), can be introduced immediately adjacent to the other side of the test sequence.

Several restriction enzymes may recognize the same restriction site. These enzymes are not identical, however, in that the cleavage sites may be at the 5' end, the center, or the 3' end of the recognition sequence. For this reason, a restriction site that is recognized by more than one restriction enzyme may be incorporated adjacent to the test site. This allows a single pool of test oligonucleotides to be used in assays employing three different DNA:protein interactions: the screening sequence has the same sequence but the restriction endonuclease used in the assay system is different in each case. Using this method to design test oligonucleotides, the UL9 screening sequence may be placed on one side of a test sequence and a restriction site screening sequence (having three cognate binding proteins) may be placed on the other side of the test sequence. Such a test oligonucleotide construction allows 4 different DNA:protein assay interaction systems to be employed with a single pool of test sequences.

One example of test oligonucleotides using several different DNA:protein interaction systems are shown in FIG. 30. The top strands of the pool of test oligonucleotides shown in FIG. 30 have 6 base pair test sequences (NNNNNN) and represent synthetic pools of all possible 4096 test sequences. The remainder of the nucleotide sequence is fixed. The test oligonucleotides contain the UL9 recognition sequence, 5'-CGTTCGCACTT (SEQ ID NO: 601)-3'. (underlined) on one side of the test sequence and a restriction endonuclease binding sequence, 5'-GGTACC-3' (bold), on the other side of the test site. The restriction endonuclease recognition sequence is recognized by the three different restriction endonucleases Asp718, RsaI and KpnI. In FIG. 30 the UL9 binding site (screening sequence) is located 3' of the test sequence: the UL9 binding site (screening sequence) can also be located 5' of the test sequence.

The shorter sequences shown above the 5' and 3' ends of the test oligonucleotides are primer sequences useful for sequencing and PCR amplification. The primer sequences contain commonly used restriction endonuclease sites for the purpose of subcloning into sequencing vectors.

Performing the assay with two or more different protein/screening sequence systems allows the confirmation of putative high affinity binding between a test compound and specific test sequences.

Alternatively, since there is no assurance that a test molecule that binds the test sequence will have the same effect on protein binding at both adjacent flanking sequences, simultaneous use of both test systems may reduce the number of false negatives detected in an assay. For example, a test molecule that does not affect the binding of protein at one screening site but may effect the binding of a different protein at the other screening site.

V. Capture/Detection Systems

As an alternative to the above described band shift gels and filter binding assays, the measurement of inhibitors can be monitored by measuring either the level of unbound DNA in the presence of test molecules or mixtures or the level of DNA:protein complex remaining in the presence of test molecules or mixtures. Measurements may be made either at equilibrium or, in a kinetic assay, prior to the time at which equilibrium is reached. The type of measurement is likely to be dictated by practical factors, such as the length of time to equilibrium, which will be determined by both the kinetics of the DNA:protein interaction as well as the kinetics of the DNA:drug interaction. The results (i.e., the detection of DNA-binding molecules and/or the determination of their sequence preferences) should not vary with the type of measurement taken (kinetic or equilibrium).

Figure 2:
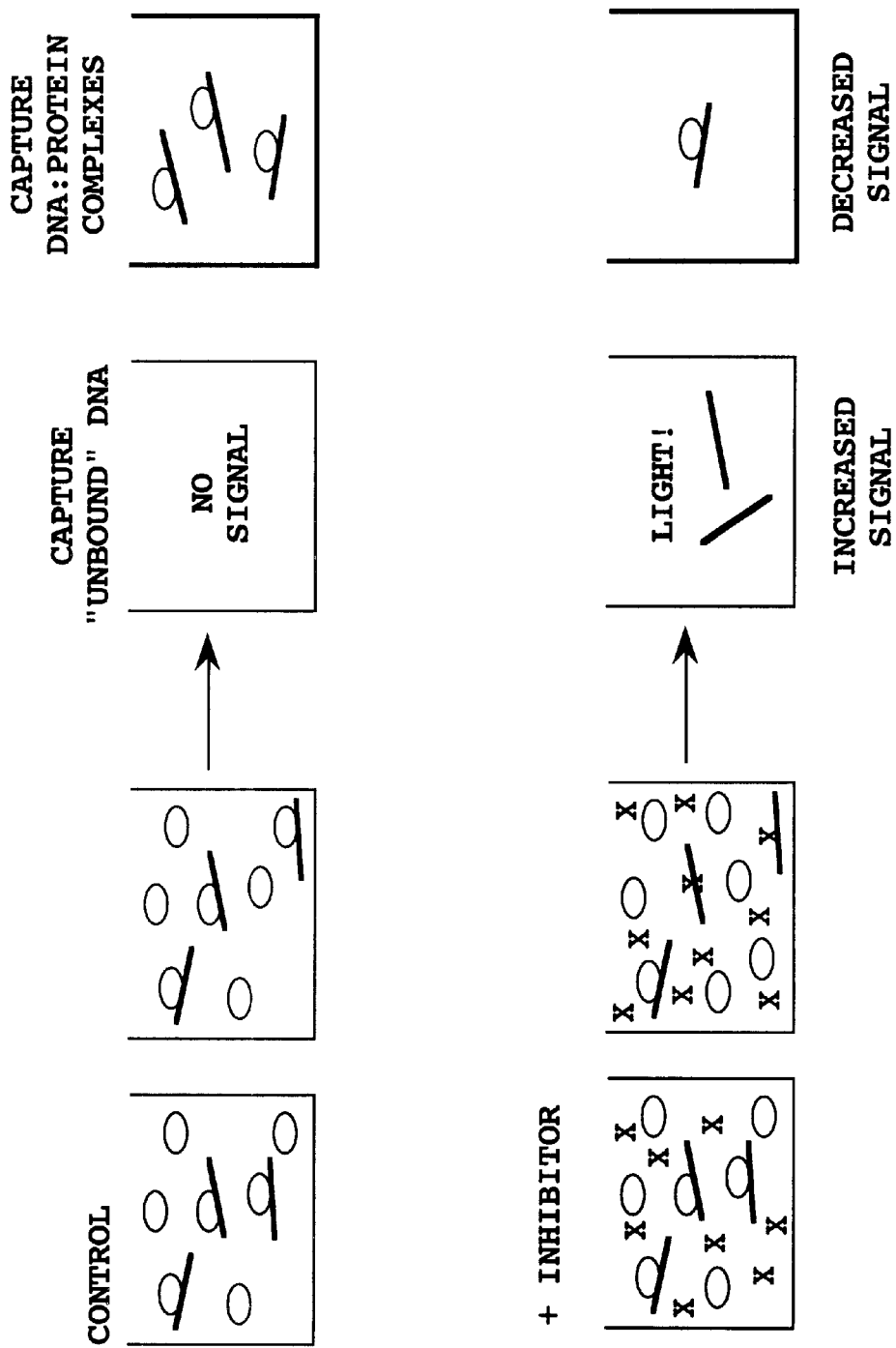
FIG. 2 illustrates an assay for detecting inhibitory molecules based on their ability to preferentially hinder the binding of a DNA-binding protein to its binding site. Protein (O) is displaced from DNA (/) in the presence of inhibitor (X). Two alternative capture/detection systems are illustrated, the capture and detection of unbound DNA or the capture and detection of DNA:protein complexes.

FIG. 2 illustrates an assay for detecting inhibitory molecules based on their ability to preferentially hinder the binding of a DNA-binding protein. In the presence of an inhibitory molecule (X) the equilibrium between the DNA-binding protein and its binding site (screening sequence) is disrupted. The DNA-binding protein (O) is displaced from DNA (/) in the presence of inhibitor (X), the DNA free of protein or, alternatively, the DNA:protein complexes, can then be captured and detected.

For maximum sensitivity, unbound DNA and DNA:protein complexes should be sequestered from each other in an efficient and rapid manner. The method of DNA capture should allow for the rapid removal of the unbound DNA from he protein-rich mixture containing the DNA:protein complexes.

Even if the test molecules are specific in their interaction with DNA they may have relatively low affinity and they may also be weak binders of non-specific DNA or have non-specific interactions with DNA at low concentrations. In either case, their binding to DNA may only be transient, much like the transient binding of the protein in solution. Accordingly, one feature of the assay is to take a molecular snapshot of the equilibrium state of a solution comprised of the test oligonucleotide DNA, the protein, and the inhibitory test molecule. In the presence of an inhibitor, the amount of DNA that is not bound to protein will be greater than in the absence of an inhibitor. Likewise, in the presence of an inhibitor, the amount of DNA that is bound to protein will be lesser than in the absence of an inhibitor.

Any method used to separate the DNA:protein complexes from unbound DNA, should be rapid, because when the capture system is applied to the solution (if the capture system is irreversible), the ratio of unbound DNA to DNA:protein complex will change at a predetermined rate, based purely on the off-rate of the DNA:protein complex. This step, therefore, determines the limits of background. Unlike the protein and inhibitor, the capture system should bind rapidly and tightly to the DNA or DNA:protein complex. The longer the capture system is left in contact with the entire mixture of unbound DNA and DNA:protein complexes in solution, the higher the background, regardless of the presence or absence of inhibitor.

Two exemplary capture systems are described below for use in the assay of the present invention. One capture system has been devised to capture unbound DNA (Section V.A). The other has been devised to capture DNA:protein complexes (Section V.B). Both systems are amenable to high throughput screening assays. The same detection methods (Section V.C) can be applied to molecules captured using either capture system.

A. Capture of Unbound DNA.

One capture system that has been developed in the course of experiments performed in support of the present invention utilizes a streptavidin/biotin interaction for the rapid capture of unbound DNA from the protein-rich mixture, which includes unbound DNA, DNA:protein complexes, excess protein and the test molecules or test mixtures. Streptavidin binds with extremely high affinity to biotin ($K_d=10^{-15}M$) (Chaiet, et al.; Green). Accordingly, two advantages of the streptavidin/biotin system are that binding between the two molecules can be rapid and the interaction is the strongest known non-covalent interaction.

Figure 3:
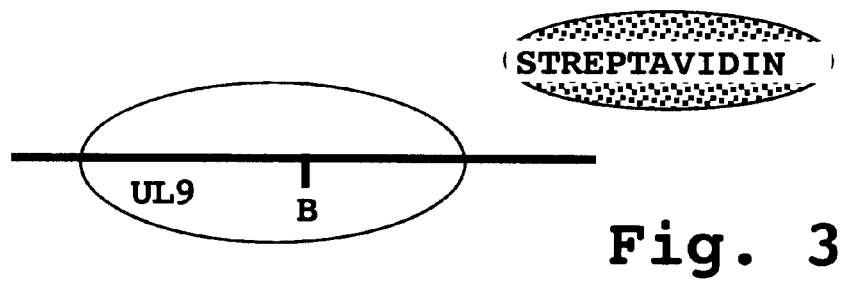
FIG. 3 shows a DNA-binding protein that is able to protect a biotin moiety, covalently attached to an oligonucleotide sequence, from being recognized by streptavidin when a protein is bound to the DNA.

In this detection system a biotin molecule is covalently attached in the oligonucleotide screening sequence (i.e., the DNA-binding protein's binding site). This attachment is accomplished in such a manner that the binding of the DNA-binding protein to the DNA is not destroyed. Further, when the protein is bound to the biotinylated sequence, the protein prevents the binding of streptavidin to the biotin. In other words, the DNA-binding protein is able to protect the biotin from being recognized by the streptavidin. This DNA:protein interaction is illustrated in FIG. 3.

The capture system is described herein for use with the UL9/oriS system described above. The following general testing principles can, however, be applied to analysis of other DNA:protein interactions. The usefulness of this system depends on the biophysical characteristics of the particular DNA:protein interaction.

1. Modification of the Protein Recognition Sequence with Biotin.

Figure 4:
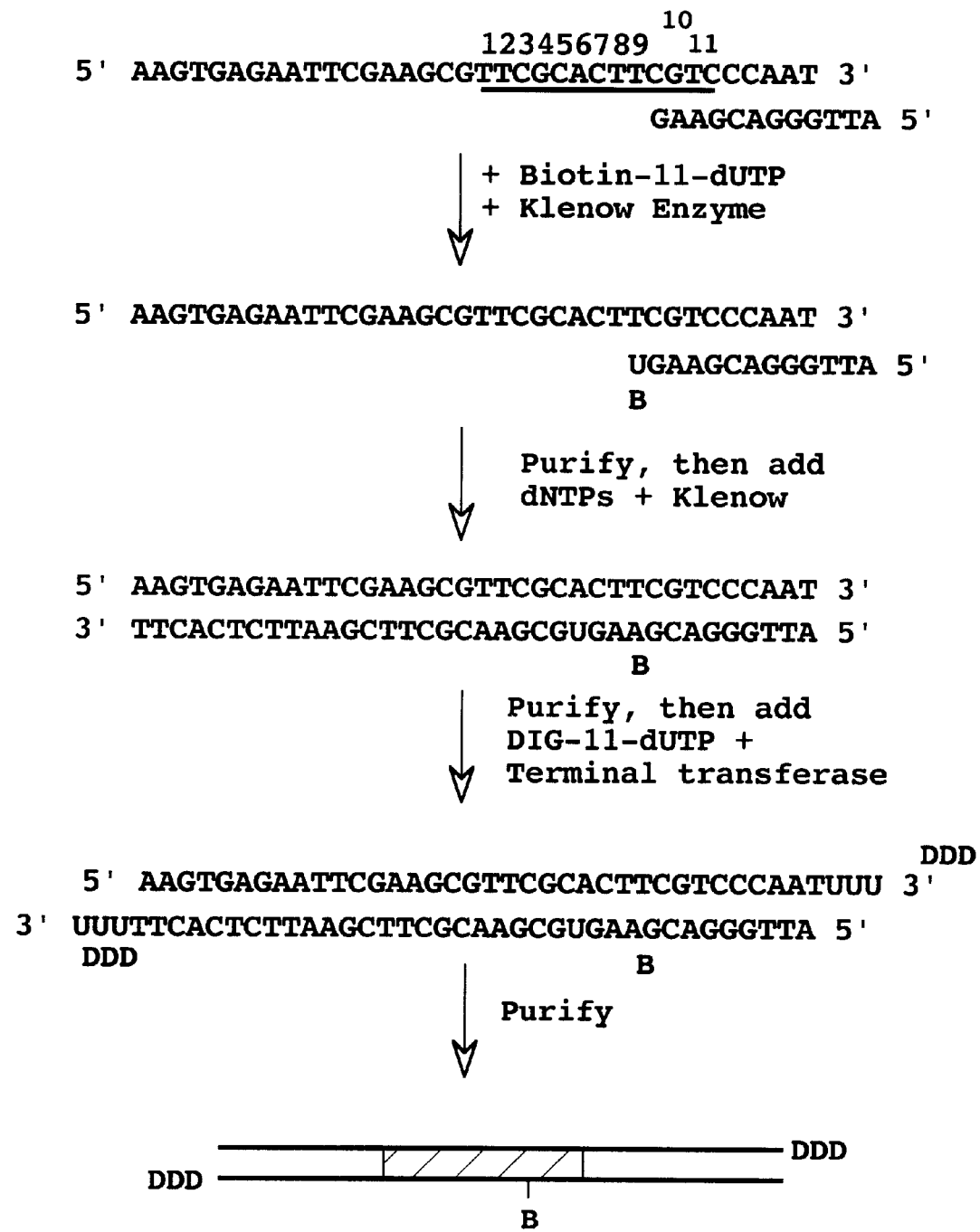
FIG. 4 shows the incorporation of biotin and digoxigenin into a typical oligonucleotide (SEQ ID NO: 614) molecule for use in the assay of the present invention. The oligonucleotide contains the binding sequence (i.e., the screening sequence) of the UL9 protein, which is underlined, and test sequences flanking the screening sequence.

The recognition sequence for the binding of the UL9 (Koff, et al.) protein is underlined in FIG. 4. Oligonucleotides were synthesized that contain the UL9 binding site and site-specifically biotinylated a number of locations throughout the binding sequence (SEQ ID NO:614; Example 1, FIG. 4). These biotinylated oligonucleotides were then used in band shift assays to determine the ability of the UL9 protein to bind to the oligonucleotide. These experiments using the biotinylated probe and a non-biotinylated probe as a control demonstrate that the presence of a biotin at the #8-T (biotinylated deoxyuridine) position of the bottom strand meets the requirements listed above: the presence of a biotin moiety at the #8 position of the bottom strand does not markedly affect the specificity of UL9 for the recognition site. Further, in the presence of bound UL9, streptavidin does not recognize the presence of the biotin moiety in the oligonucleotide. Biotinylation at other A or T positions did not have the two necessary characteristics (i.e., UL9 binding and protection from streptavidin): biotinylation at the adenosine in position #8, of the top strand, prevented the binding of UL9; biotinylation of either adenosines or thymidines (top or bottom strand) at positions #3, #4, #10, or #11 all allowed binding of UL9, but in each case, streptavidin also was able to recognize the presence of the biotin moiety and thereby bind the oligonucleotide in the presence of UL9.

The above result (the ability of UL9 to bind to an oligonucleotide containing a biotin within the recognition sequence and to protect the biotin from streptavidin) was unexpected in that methylation interference data (Koff, et al.) suggest that methylation of the deoxyguanosine residues at positions #7 and #9 of the recognition sequence (on either side of the biotinylated deoxyuridine) blocks UL9 binding. In these methylation interference experiments, guanosines are methylated by dimethyl sulfate at the $N^7$ position, which corresponds structurally to the 5-position of the pyrimidine ring at which the deoxyuridine is biotinylated. These moieties all protrude into the major groove of the DNA. The methylation interference data suggest that the #7 and #9 position deoxyguanosines are contact points for UL9, it was therefore unexpected that the presence of a biotin moiety between them would not interfere with binding.

The binding of the full length protein was relatively unaffected by the presence of a biotin at position #8 within the UL9 binding site. The rate of dissociation was similar for full length UL9 with both biotinylated and unbiotinylated oligonucleotides. However, the rate of dissociation of the truncated UL9-COOH polypeptide was faster with the biotinylated oligonucleotides than with non-biotinylated oligonucleotides (for non-biotinylated oligonucleotides the rate comparable to that of the full length protein with either DNA).

The binding conditions were optimized for UL9-COOH so that the half-life of the truncated UL9 from the biotinylated oligonucleotide was 5–10 minutes (optimized conditions are given in Example 4), a rate compatible with a mass screening assay. The use of multi-well plates to conduct the DNA:protein assay of the present invention is one approach to mass screening.

2. Capture of Site-Specific Biotinylated Oligonucleotides.

The streptavidin:biotin interaction can be employed in several different ways to remove unbound DNA from the solution containing the DNA, protein, and test molecule or mixture. Magnetic polystyrene or agarose beads, to which streptavidin is covalently attached or attached through a covalently attached biotin, can be exposed to the solution for a brief period, then removed by use, respectively, of magnets or a filter mesh. Magnetic streptavidinated beads are currently the method of choice. Streptavidin has been used in many of these experiments, but avidin is equally useful.

An example of a second method for the removal of unbound DNA is to attach streptavidin to a filter by first linking biotin to the filter, binding streptavidin, then blocking nonspecific protein binding sites on the filter with a nonspecific protein such as albumin. The mixture is then passed through the filter, unbound DNA is captured and the bound DNA passes through the filter. This method can give high background due to partial retention of the DNA:protein complex on the filter.

One convenient method to sequester captured DNA is the use of streptavidin-conjugated superparamagnetic polystyrene beads as described in Example 7. These beads are added to the assay mixture to capture the unbound DNA. After capture of DNA, the beads can be retrieved by placing the reaction tubes in a magnetic rack, which sequesters the beads on the reaction chamber wall while the assay mixture is removed and the beads are washed. The captured DNA is then detected using one of several DNA detection systems, as described below.

Alternatively, avidin-coated agarose beads can be used. Biotinylated agarose beads (immobilized D-biotin, Pierce) are bound to avidin. Avidin, like streptavidin, has four binding sites for biotin. One of these binding sites is used to bind the avidin to the biotin that is coupled to the agarose beads via a 16 atom spacer arm: the other biotin binding sites remain available. The beads are mixed with binding mixtures to capture biotinylated DNA (Example 7). Alternative methods (Harlow, et al.) to the bead capture methods just described include the following streptavidinated or avidinated supports: low-protein binding filters, or 96-well plates.

B. Capture of DNA:Protein Complexes.

The amount of DNA:protein complex remaining in the assay mixture in the presence of an inhibitory molecule can also be determined as a measure of the relative effect of the inhibitory molecule. A net decrease in the amount of DNA:protein complex in response to a test molecule is an indication of the presence of an inhibitor. DNA molecules that are bound to protein can be captured on nitrocellulose filters. Under low salt conditions, DNA that is not bound to protein freely passes through the filter. Thus, by passing the assay mixture rapidly through a nitrocellulose filter, the DNA:protein complexes and unbound DNA molecules can be rapidly separated. This has been accomplished on nitrocellulose discs using a vacuum filter apparatus or on slot blot or dot blot apparatuses (all of which are available from Schleicher and Schuell, Keene, N.H.). The assay mixture is applied to and rapidly passes through the wetted nitrocellulose under vacuum conditions. Any apparatus employing nitrocellulose filters or other filters capable of retaining protein while allowing free DNA to pass through the filter would be suitable for this system.

C. Detection Systems.

For either of the above capture methods, the amount of DNA that has been captured is quantitated. The method of quantitation depends on how the DNA has been prepared. If the DNA is radioactively labelled, beads can be counted in a scintillation counter, or autoradiographs can be taken of dried gels or nitrocellulose filters. The amount of DNA has been quantitated in the latter case by a densitometer (Molecular Dynamics, Sunnyvale, Calif.); alternatively, filters or gels containing radiolabeled samples can be quantitated using a phosphoimager (Molecular Dynamics). Further, the captured DNA may be detected using a chemiluminescent or calorimetric detection system.

Radiolabelling and chemiluminescence (i) are very sensitive, allowing the detection of sub-femtomole quantities of oligonucleotide, and (ii) use well-established techniques. In the case of chemiluminescent detection, protocols have been devised to accommodate the requirements of a mass-screening assay. Non-isotopic DNA detection techniques have principally incorporated alkaline phosphatase as the detectable label given the ability of the enzyme to give a high turnover of substrate to product and the availability of substrates that yield chemiluminescent or colored products.

1. Radioactive Labeling.

Many of the experiments described above for UL9 DNA:protein-binding studies have made use of radiolabelled oligonucleotides. The techniques involved in radiolabelling of oligonucleotides have been discussed above. A specific activity of $10^8$–$10^9$ dpm per $\mu$g DNA is routinely achieved using standard methods (e.g., end-labeling the oligonucleotide with adenosine $\gamma$-[$^{32}$P]-5' triphosphate and T4 polynucleotide kinase). This level of specific activity allows small amounts of DNA to be measured either by autoradiography of gels or filters exposed to film or by direct counting of samples in scintillation fluid.

2. Chemiluminescent Detection.

For chemiluminescent detection, digoxigenin-labelled oligonucleotides (Example 1) can be detected using the chemiluminescent detection system "SOUTHERN LIGHTS," developed by Tropix, Inc. (Bedord, Mass.). The detection system is diagrammed in FIGS. 11A and 11B. The technique can be applied to detect DNA that has been captured on either beads, filters, or in solution.

Alkaline phosphatase is coupled to the captured DNA without interfering with the capture system. To do this several methods, derived from commonly used ELISA (Harlow, et al.; Pierce, Rockford Ill.) techniques, can be employed. For example, an antigenic moiety is incorporated into the DNA at sites that will not interfere with (i) the DNA:protein interaction, (ii) the DNA:drug interaction, or (iii) the capture system. In the UL9 DNA:protein/biotin system the DNA has been end-labelled with digoxigenin-11-dUTP (dig-dUTP) and terminal transferase (Example 1, FIG. 4). After the DNA was captured and removed from the DNA:protein mixture, an anti-digoxigenin-alkaline phosphatase conjugated antibody was then reacted (Boehringer Mannheim, Indianapolis Ind.) with the digoxigenin-containing oligonucleotide. The antigenic digoxigenin moiety was recognized by the antibody-enzyme conjugate. The presence of dig-dUTP altered neither the ability of UL9-COOH protein to bind the oriS (SEQ ID NO:601)-containing DNA nor the ability of streptavidin to bind the incorporated biotin.

Captured DNA was detected using the alkaline phosphatase-conjugated antibodies to digoxigenin as follows. One chemiluminescent substrate for alkaline phosphatase is 3-(2'-spiroadamantane)-4-methoxy-4-(3"-phosphoryloxy) phenyl-1,2-dioxetane disodium salt (AMPPD) (Example 7). Dephosphorylation of AMPPD results in an unstable compound, which decomposes, releasing a prolonged, steady emission of light at 477 nm. Light measurement is very sensitive and can detect minute quantities of DNA (e.g., $10^2$–$10^3$ attomoles) (Example 7).

Colorimetric substrates for the alkaline phosphatase system have also been tested. While the calorimetric substrates are useable in the present assay system, use of the light emission system is more sensitive.

An alternative to the above biotin capture system is to use digoxigenin in place of biotin to modify the oligonucleotide at a site protected by the DNA-binding protein at the assay site: biotin is then used to replace the digoxigenin moieties in the above described detection system. In this arrangement the anti-digoxigenin antibody is used to capture the oligonucleotide probe when it is free of bound protein. Streptavidin conjugated to alkaline phosphatase is then used to detect the presence of captured oligonucleotides.

D. Alternative Methods for Detecting Molecules that Increase the Affinity of the DNA-Binding Protein for its Cognate Site.

In addition to identifying molecules or compounds that cause a decreased affinity of the DNA-binding protein for the screening sequence, molecules may be identified that increase the affinity of the protein for its cognate binding site. In this case, leaving the capture system for unbound DNA in contact with the assay for increasing amounts of time allows the establishment of a fixed half-life for the DNA:protein complex (for example, using SEQ ID NO:601/UL9). In the presence of a stabilizing molecule, the half-life, as detected by the capture system time points, will be shortened.

Using the capture system for DNA:protein complexes to detect molecules that increase the affinity of the DNA-binding protein for the screening sequence requires that an excess of unlabeled oligonucleotide containing the UL9 binding site (but not the test sequences) is added to the assay mixture. This is, in effect, an off-rate experiment. In this case, the control sample (no test molecules or mixtures added) will show a fixed off-rate. For example, samples would be taken at fixed intervals after the addition of the unlabeled competition DNA molecule, applied to nitrocellulose, and a decreasing amount of radiolabeled DNA:protein complex would be observed). In the presence of a DNA-binding test molecule that enhanced the binding of UL9, the off-rate would be decreased (i.e., the amount of radiolabeled DNA:protein complexes observed would not decrease as rapidly at the fixed time points as in the control sample).

VI. Utility

A. The Usefulness of Sequence-Specific DNA-Binding Molecules.

The present invention defines a high through-put in vitro screening assay to test large libraries of biological or chemical mixtures for the presence of DNA-binding molecules having sequence binding preference. The assay is also capable of determining the sequence-specificity and relative affinity of known DNA-binding molecules or purified unknown DNA-binding molecules. Sequence-specific DNA-binding molecules are of particular interest for several reasons, which are listed here. These reasons, in part, outline the rationale for determining the usefulness of DNA-binding molecules as therapeutic agents:

First, for a given DNA:protein interaction, there are generally several thousands fewer target DNA-binding sequences per cell than protein molecules that bind to the DNA. Accordingly, even fairly toxic molecules might be delivered in sufficiently low concentration to exert a biological effect by binding to the target DNA sequences.

Second, DNA has a relatively more well-defined structure compared to RNA or protein. Since the general structure of DNA has less tertiary structural variation, identifying or designing specific binding molecules should be easier for DNA than for either RNA or protein. Double-stranded DNA is a repeating structure of deoxyribonucleotides that stack atop one another to form a linear helical structure. In this manner, DNA has a regularly repeating "lattice" structure that makes it particularly amenable to molecular modeling refinements and hence, drug design and development.

Third, since many single genes (i.e., genes which have only 1 or 2 copies in the cell) are transcribed into more than one, potentially as many as thousands of RNA molecules, each of which may be translated into many proteins, targeting any DNA site, whether it is a regulatory sequence, non-coding sequence or a coding sequence, may require a much lower drug dose than targeting RNAs or proteins. Proteins (e.g., enzymes, receptors, or structural proteins) are currently the targets of most therapeutic agents. More recently, RNA molecules have become the targets for anti-sense or ribozyme therapeutic molecules.

Fourth, blocking the function of a RNA that encodes a protein or of the protein itself when that protein regulates several cellular genes may have detrimental effects: particularly if some of the regulated genes are important for the survival of the cell. However, blocking a DNA-binding site that is specific to a single gene regulated by such a protein results in reduced toxicity.

An example situation is HNF-1 binding to Hepatitis B virus (HBV): HNF-1 binds an HBV enhancer sequence and stimulates transcription of HBV genes (Chang, et al.). In a normal cell HNF-1 is a nuclear protein that appears to be important for the regulation of many genes, particularly liver-specific genes (Courtois, et al.). If molecules were isolated that specifically bound to the DNA-binding domain of HNF-1, all of the genes regulated by HNF-1 would be down-regulated, including both viral and cellular genes. Such a drug could be lethal since many of the genes regulated by HNF-1 may be necessary for liver function. However, the assay of the present invention presents the ability to screen for a molecule that could distinguish the HNF-1 binding region of the Hepatitis B virus DNA from cellular HNF-1 sites by, for example, including divergent flanking sequences when screening for the molecule. Such a molecule would specifically block HBV expression without effecting cellular gene expression.

B. General Applications of the Assay.

General applications of the assay include but are not limited to: screening libraries of unknown chemicals, either biological or synthetic compounds, for sequence-specific DNA-binding molecules, determining the sequence-specificity or preference and/or relative affinities of DNA-binding molecules, testing of modified derivatives of DNA-binding molecules for altered specificity or affinity, using the assay in secondary confirmatory or mechanistic experiments, using the data generated from the above applications to refine the predictive capabilities of molecular modeling systems, and using the refined molecular modeling systems to generate a new "alphabet" of DNA-binding subunits that can be polymerized to make novel heteropolymers designed de novo to bind specific DNA target sites.

1. Mass-Screening of Libraries for the Presence of Sequence-Specific DNA-Binding Molecules.

Many organizations (e.g., the National Institutes of Health, pharmaceutical and chemical corporations) have large libraries of chemical or biological compounds from synthetic processes or fermentation broths or extracts that may contain as yet unidentified DNA-binding molecules. One utility of the assay is to apply the assay system to the mass-screening of these libraries of different broths, extracts, or mixtures to detect the specific samples that contain the DNA-binding molecules. Once the specific mixtures that contain the DNA-binding molecules have been identified, the assay has a further usefulness in aiding in the purification of the DNA-binding molecule from the crude mixture. As purification schemes are applied to the mixture, the assay can be used to test the fractions for DNA-binding activity. The assay is amenable to high throughput (e.g., a 96-well plate format automated on robotics equipment such as a Beckman Biomek workstation [Beckman, Palo Alto, Calif.] with detection using semi-automated plate-reading densitometers, luminometers, or phosphoimagers).

The concentration of protein used in mass-screening is determined by the sensitivity desired. The screening of known compounds, as described in Section VI.B.2, is typically performed in protein excess at a protein concentration high enough to produce 90–95% of the DNA bound in DNA:protein complex. The assay is very sensitive to discriminatory inhibition at this protein concentration. For some mass-screening, it may be desirable to operate the assay under higher protein concentration, thus decreasing the sensitivity of the assay so that only fairly high affinity molecules will be detected: for example, when screening fermentation broths with the intent of identifying high affinity binding molecules. The range of sensitivities in the assay will be determined by the absolute concentration of protein used.

One utility of the method of the present invention, under conditions using a relatively insensitive system (high [P]:[D] ratio), is as a screening system for novel restriction enzymes. In this case, an ability to discriminate between slight differences in affinity to different sequences may not be necessary or desirable. Restriction enzymes have highly discriminatory recognition properties—the affinity constant of a restriction endonuclease for its specific recognition sequence versus non-specific sequences are orders of magnitude different from one another. The assay may be used to screen bacterial extracts for the presence of novel restriction endonucleases. The 256 test oligonucleotides described in Example 10, for example, may be used to screen for novel restriction endonucleases with 4 bp recognition sequences. The advantages of the system are that all possible 4 bp sequences are screened simultaneously, that is, it is not limited to self-complementary sequences. Further, any lack of specificity (such as, more than one binding site) is uncovered during the primary screening assay.

2. Directed Screening.

The assay of the present invention is also useful for screening molecules that are currently described in the literature as DNA-binding molecules but with uncertain DNA-binding sequence specificity (i.e., having either no well-defined preference for binding to specific DNA sequences or having certain higher affinity binding sites but without defining the relative preference for all possible DNA binding sequences). The assay can be used to determine the specific binding sites for DNA-binding molecules, among all possible choices of sequence that bind with high, low, or moderate affinity to the DNA-binding molecule. Actinomycin D, Distamycin A, and Doxorubicin (Example 6) all provide examples of molecules with these modes of binding. Many anti-cancer drugs, such as Doxorubicin (see Example 6), show binding preference for certain identified DNA sequences, although the absolute highest and lowest specificity sequences have yet to be determined, because, until the invention described herein, methods (Salas and Portugal; Cullinane and Phillips; Phillips; and Phillips, et al.) for detecting differential affinity DNA-binding sites for any drug were limited. Doxorubicin is one of the most widely used anti-cancer drugs currently available. As shown in Example 6, Doxorubicin is known to bind some sequences preferentially. Another example of such sequence binding preference is Daunorubicin (Chen, et al.) which differs slightly in structure from Doxorubicin (Goodman, et al.). Both Daunorubicin and Doxorubicin are members of the anthracycline antibiotic family: antibiotics in this family, and their derivatives, are among the most important newer antitumor agents (Goodman, et al.).

The assay of the present invention allows the sequence preferences or specificities of DNA-binding molecules to be determined. The DNA-binding molecules for which sequence preference or specificity can be determined may include small molecules such as aminoacridines and polycyclic hydrocarbons, planar dyes, various DNA-binding antibiotics and anticancer drugs, as well as DNA-binding macromolecules, such as, peptides and polymers that bind to nucleic acids (e.g., DNA and the derivatized homologs of DNA that bind to the DNA helix).

The molecules that can be tested in the assay for sequence preference/specificity and relative affinity to different DNA sites include both major and minor groove binding molecules as well as intercalating and non-intercalating DNA binding molecules.

3. Molecules Derived from Known DNA-binding Molecules.

The assay of the present invention facilitates the identification of different binding activities by molecules derived from known DNA-binding molecules. An example of this would be to identify and test derivatives of anti-cancer drugs that have DNA-binding activity and then test for anti-cancer activity through, for example, a battery of assays performed by the National Cancer Institute (Bethesda Md.). Further, the assay of the present invention can be used to test derivatives of known anti-cancer agents to examine the effect of the modifications on DNA-binding activity and specificity. In this manner, the assay may reveal activities of anti-cancer agents, and derivatives of these agents, that facilitate the design of DNA-binding molecules with therapeutic or diagnostic applications in different fields, such as antiviral or antimicrobial therapeutics. The binding-activity information for any DNA-binding molecule, obtained by application of the present assay, can lead to a better understanding of the mode of action of more effective therapeutics.

4. Secondary Assays.

As described above, the assay of the present invention is used (i) as a screening assay to detect novel DNA-binding molecules, or (ii) to determine the relative specificity and affinity of known molecules (or their derivatives). The assay may also be used in confirmatory studies or studies to elucidate the binding characteristics of DNA-binding molecules. Using the assay as a tool for secondary studies can be of significant importance to the design of novel DNA-binding molecules with altered or enhanced binding specificities and affinities.

a.) Confirmatory Studies.

The assay of the present invention can be used in competition studies to confirm and refine the original direct binding data obtained from the assay.

The primary screening assay does not provide for the direct determination of relative absolute affinities of test molecules for different test sequences. A competition method has been developed that aids in the interpretation and confirmation of the primary screening assay. The competition method also provides a means for determining the minimum difference in absolute affinities of any test sequences for a given test molecule.

Sequences of interest are tested for their ability to compete with the test oligonucleotide for binding a test molecule of interest. In this method, DNA molecules that contain sequences that are high affinity binding sites for the DNA-binding test molecule compete effectively with the test oligonucleotide for the binding of the test molecule. DNA molecules that contain sequences that are low affinity binding sites for the test molecules are ineffective competitors. In effect, the fold-difference in concentration required between a high affinity competitor DNA and a low affinity competitor DNA, where the competitor is required to compete with the test oligonucleotide for the binding of the DNA-binding test molecule, should be proportional to the difference in affinity between the two competitor DNA molecules.

Any test oligonucleotide may be used in the competition study. However, in practice, since most secondary screening will be used to examine the putative high affinity binding test sequences, the secondary competition assay is typically used to test a competitor oligonucleotide which is a putative high affinity test sequence.

In the competition assay, the assay conditions are essentially the same as the conditions used in the primary screening assay. The assay components are mixed, with the exception of the DNA. The mixture includes protein, buffer and the DNA-binding test molecule (control samples lack the test molecule). A test oligonucleotide is labeled (for example, using a radioisotope, although any of the described capture/detection systems should be effective in the competition study). The DNA sample, including the radiolabeled test oligonucleotide and unlabelled competitor DNA is added to the assay mixture. Typically, the competitor DNA of interest is added to different reactions over a range of competitor concentrations. Two controls are commonly run: (i) no DNA binding test molecule added; and (ii) test DNA but no competitor DNA added.

The reactions are incubated for the desired time and the DNA:protein complexes separated from free DNA (i.e., DNA not associated with protein) by passing the mixture through nitrocellulose. Other capture systems, such as the biotin/streptavidin system discussed in Section V, are also effective. The amount of radiolabeled test oligonucleotide bound by protein (i.e., bound to the filter) is indicative of the effect of the competitor.

One example of a competition assay is as follows. A test oligonucleotide containing the test sequence TTAC ranks as a high affinity binding site for a test molecule. The TTAC test oligonucleotide is radiolabeled and mixed with non-radiolabeled competitor DNAs that contain, for example, a putative high affinity binding site (the same site, TTAC, is one example) or a putative low affinity binding site (e.g., CCCC). In the absence of any competing nonlabeled DNA or DNA-binding test molecule, the amount of radiolabeled DNA:protein complex observed (called r %) is arbitrarily established as 100%. The concentration of the protein used in this experiment is high enough to bind most of the radiolabelled test oligonucleotide in the absence of test molecules or competing DNA molecules (this is essentially the same concentration as used in the primary screening assay).

The test molecule is added to the reaction at a concentration sufficient to markedly reduce r %, the amount of observed DNA:protein complex. The greater the reduction in signal, the more easily competition is observed. The amount of competitor DNA needed to observe competition is proportional to the amount of DNA-binding test molecule used; therefore, the amount of test molecule used should be sufficient to reduce r % to between approximately 10% to 70%. The effect of an effective competitor, such as TTAC, is to cause r % to rise towards 100%.

The competition for test molecule binding is between the non-labeled competitor DNA and the radiolabeled test oligonucleotide. As the competitor DNA concentration increases, the test molecule binds to the competitor DNA and is effectively removed from solution. Accordingly, the test molecule is no longer able to block the binding of the protein to the radiolabeled oligonucleotide. A less effective competitor, typically a competitor DNA with low affinity for the test molecule, will compete less effectively for the DNA-binding test molecule, even at substantially higher concentrations than the high affinity competitor. A completely ineffective competitor, i.e., one that did not bind the test molecule, would not cause the r % value to change, even at high concentrations of the competitor DNA.

When a competitor DNA has some affinity for the test molecule, competition (r % rising towards 100%) would be observed at some competitor DNA concentration. The difference in concentration between two competing DNA sequences to achieve an equivalent r % (e.g., 90%) should reflect the relative difference in absolute affinity between the two competitor DNA molecules. For example, if 5 $\mu$M TTAC is required to achieve a change in r % from 50% to 90% in the presence of a test molecule and 200 $\mu$M CCCC is required to achieve the same change in r %, then the i-old difference in affinity between TTAC and CCCC for the test molecule is 200/5=40-fold.

In the context of screening distamycin with all possible 256 bp test sequences (Example 10), the confirmatory assay can be used (i) to confirm the rankings observed in the assay, (ii) to refine the rankings among the 5–10 highest ranked binders (which show no statistical difference in rank with data from 4 experiments), and (iii) to resolve perceived discrepancies in the assay data. All of these goals may be accomplished using a competition experiment which determines the relative ability of test sequences to compete for the binding of distamycin.

The perceived discrepancy in the distamycin experiment is as follows: test oligonucleotides scored poorly in the assay which were complementary to most of the top-ranking test sequence oligonucleotides (Examples 10 and 11). This result was unexpected since it is unlikely that the affinity of distamycin for binding a test site depends on the orientation of the screening site to the test site. More likely, the assay detects the binding of distamycin when the molecule is bound to the test oligonucleotide in one orientation, but fails to detect the binding of distamycin when the test sequence is in the other orientation. A competition study will resolve this question, since the binding of distamycin to a competitor sequence will be orientation-independent; the competition does not depend on the mechanism of the assay.

For the competition experiment, the assay may be performed under any conditions suitable for the detection of drug binding. When these conditions are established, different competitor DNAs are added to the assay system to determine their relative ability to compete for drug binding with the radiolabeled test oligonucleotide in the assay system.

The competitor DNAs may be any sequence of interest. Several classes of DNA may be tested as competitor molecules including, but not limited to, the following: genomic DNAs, synthetic DNAs (e.g., poly(dA), poly(dI-dC), and other DNA polymers), test oligonucleotides of varying sequences, or any molecule of interest that is thought to compete for distamycin binding.

When using the competition assay to verify the results of a 256 oligonucleotide panel screen (like Example 10), the following criteria are useful for selecting the competitor test oligonucleotides:

(i) sequences that rank high in the assay but which do not have relative binding affinities with differences that are statistically significant from each other, in order to determine their relative affinity with greater precision;

(ii) sequences that are purported by other techniques (e.g., footprinting or transcriptional block analysis) to be high affinity binding sites, in order to compare the results of those techniques with the screening assay results;

(iii) sequences that are complementary to test sequences that rank high in the assay, in order to determine whether these test sequences are false negatives; and (iv) sequences of any rank in the assay, in order to confirm the assay results.

Several methods may be used to perform the competition study as long as the relative affinities of the competing DNA molecules are detectable. One such method is described in Example 14. In this example, the concentration of the assay components (drug, protein, and DNA) is held constant relative to those used in the original screening assay, but the molar ratio of the test oligonucleotide to the competitor oligonucleotides is varied.

Another method for performing a competition assay is to hold the concentrations of protein, drug and initial amount of test oligonucleotide constant, then add a variable concentration of competitor DNA. In this design, the protein and drug concentration must be sufficiently high to allow the addition of further competitor DNA without i) decreasing the amount of DNA:protein complex in the absence of drug to a level that is unsuitable for detection of DNA:protein complex, and ii) increasing the amount of DNA:protein complex in the presence of drug to a level that is unsuitable for the detection of drug binding. The window between detectable DNA:protein complex and detectable effect of the drug must be wide enough to determine differences among competitor DNAs.

In any competition method, it is important that the relative concentrations of the competing DNA molecules are accurately determined. One method for accomplishing accurate determination of the relative concentrations of the DNA molecules is to tracer-label competitor molecules to a low specific activity with a common radiolabeled primer (Example 14). In this manner, the competitor molecules have the same specific activity, but are not sufficiently radioactive (200-fold less than the test oligonucleotide) to contribute to the overall radioactivity in the assay.

b.) Secondary Studies to Elucidate Binding Characteristics.

The studies outlined in Section VI.B.4.a describe methods of determining some of the binding processes of distamycin A. The assay of the present invention may also be used to explore mechanistic questions about distamycin binding.

For example, several of the complements of the putative high affinity binding sites for distamycin have low scores in the assay. As described above, this may imply directionality in binding. The results may also imply that the test sites are not equal with respect to the effect exerted on UL9-COOH binding. Oligonucleotides can be designed to test the hypothesis of directionality.

The basic test oligonucleotide has the structure presented in FIG. 27A (SEQ ID NO:621). In one scenario, the score in the binding assay is high, i.e., the greatest effect of distamycin, when the test sequences is XYZZ (FIG. 27A, with the base X complementary to the base Y and the base Q complementary to the base Z), and the complement (FIG. 27B; SEQ ID NO:622) scores low. These results imply that the test sites are not equivalent with respect to their effect on UL9, otherwise the right side would have the effect in one oligonucleotide and the left site would have the effect in the other. These results further suggest that the effect of distamycin is directional. The only assumption is that distamycin should bind with the same affinity to the XYZZ/QQXY sequence (FIGS. 27A and 27B) regardless of its position or orientation in the oligonucleotide. Since the scores are derived at equilibrium, this is likely to be the case.

To test the hypothesis that one site is effective in the assay, oligonucleotides may be designed that have the UL9 site inverted with respect to the test sites (FIGS. 27C and 27D; SEQ ID NO:623 and SEQ ID NO:624, respectively). If only one site is active with respect to UL9 and if the FIG. 27A oligo was most effective in binding distamycin, then the oligo C should be less active in the assay then oligo D; in other words, flipping the UL9 site will result in QQXY ranking high, XYZZ ranking low.

Finally, to determine the "direction" of distamycin binding, mix test sequences and invert the binding site as shown in the four oligonucleotides presented in FIGS. 27E, 27F, 27G and 27H. Alternatively, one test site or the other could be deleted from the test oligonucleotide.

This type of analysis provides an example of the usefulness in the assay in determining binding properties of DNA-binding drugs.

c.) Restriction Endonucleases as Indicator Proteins in the Assay.

Other DNA:protein interactions that are useful as screening sequences and their cognate binding proteins (indicator proteins) are restriction enzymes. Such secondary screening assays are performed using the same criteria to establish conditions for the primary screening assay (described in Example 4). The assay conditions can be varied to accommodate different DNA:protein interactions, as long as the assay system follows the functional criteria discussed above (Section I).

One limitation of using restriction endonucleases in the method of the present invention is that the assay buffer should not contain divalent cations. In the absence of divalent cations, the enzymes will bind the appropriate recognition sequence, but not cleave the DNA. In the presence of divalent cations, the test oligonucleotide can be cleaved at or near the protein binding site.

By using different indicator proteins, a different recognition sequence can be used to flank the test site. This variation allows the resolution of questions regarding the potential binding of a test molecule to a site internal to any single screening sequence. For example, the assay system is used where the UL9 protein and its recognition sequence are used as the indicator protein:screening sequence interaction. In this system, if the highest affinity binding site for a test molecule is TTAC, then several test sequences may be predicted to rank high in the assay system: several of these test sequences are presented in FIG. 31. In FIG. 31, the test site is shown in bold, the potential binding site for the test molecule is shown underlined.

One test oligonucleotide on which the DNA-binding test molecule would be predicted to have a high level of effect is the oligonucleotide containing the test site, TTAC (FIG. 31). However, since the UL9 recognition sequence contains the sequence TT, flanking the test site, several other test oligonucleotides might also be expected to have high activity in the assay (see FIG. 31).

By using a different DNA:protein interaction as the indicator system in a secondary screening assay, the "false positives" shown for TACN and ACNN (shown in FIG. 31) can be identified. The recognition sequence for the protein in a secondary screening assay simply needs to have a different screening sequence in the region flanking the test site than the UL9 screening sequence.

Restriction endonucleases provide an entire class of different DNA:protein interactions with a wide array of available sequences that can be used in this manner. For example, SmaI recognizes the sequence 5'-CCCGGG-3'. Using the SmaI:DNA interaction and the same test sequences presented in FIG. 31, the resulting test oligonucleotides would have the test sequences presented in FIG. 32. As can be seen from a comparison of FIGS. 31 and 32, changing the screening sequence from the UL9-binding sequence to the SmaI-binding sequence eliminates the potential test molecule binding sites internal to the screening sequence (e.g., compare TACN and ACNN in the figures).

The use of different DNA-binding proteins as indicator proteins in the assay is also applicable to the PCR-based test oligonucleotide selection technology (Section III).

5. Generation of Binding Data and Refinement of Molecular Modeling Systems.

The assay of the present invention generates data which can be applied to the refinement of molecular modeling systems that address DNA structural analysis: the data is also useful in the design and/or refinement of DNA-binding drugs. Traditionally, mass screening has been the only reasonable method for discovering new drugs. Modern rational drug design seeks to minimize laboratory screening. However, ab initio rational drug design is difficult at this time given (i) insufficiencies in the underlying theories used for de novo design, and (ii) the computational intensity which accompanies such design approaches.

The ab initio approach requires calculations from first principles by quantum mechanics: such an approach is expensive and time-consuming. The introduction of data concerning the relative binding affinities of one or more DNA-binding molecules to all 256 four base pair DNA sequences allows the development, via molecular modeling, of ad hoc protocols for DNA structural analysis and subsequent DNA-binding drug design. The accumulation of data for the DNA sequences to which small molecules bind is likely to result in more accurate, less expensive molecular modeling programs for the analysis of DNA.

The screening capacity of the assay of the present invention is much greater than screening a single DNA sequence with an individual cognate DNA-binding protein. Direct competition assays involving individual receptor:ligand complexes (e.g., a specific DNA:protein complex) are most commonly used for mass screening efforts. Each such assay requires the identification, isolation, purification, and production of the assay components. In particular, a suitable DNA:protein interactions must be identified for each selected screening sequence. Using the assay of the present invention, libraries of synthetic chemicals or biological molecules can be screened to detect molecules that have preferential binding to virtually any specified DNA sequence—all using a single assay system. When employing the assay of the present invention, secondary screens involving the specific DNA:protein interaction may not be necessary, since inhibitory molecules detected in the assay may be tested directly on a biological system: for example, the ability to disrupt viral replication in a tissue culture or animal model.

6. The Design of New DNA-Binding Heteropolymers Comprised of Subunits Directed to Different DNA Sequences.

The assay of the present invention will facilitate the predictive abilities of molecular modeling systems in two ways. First, ad hoc methods of structural prediction will be improved. Second, by employing pattern matching schemes, the comparison of sequences having similar or different affinities for a given set of DNA-binding molecules should empirically reveal sets of sequences that have similar structures (see Section VI.D, Using a Test Matrix). Molecular modeling programs are "trained" using the information concerning DNA-binding molecules and their preferred binding sequences. With this information coupled to the predicative power of molecular modeling programs, the design of DNA-binding molecules (subunits) that could be covalently linked becomes feasible.

These molecular subunits would be directed at defined sections of DNA. For example, a subunit would be designed for each possible DNA unit. For example, if single bases were the binding target of the subunits, then four subunits would be required, one to correspond to each base pair. These subunits could then be linked together to form a DNA-binding polymer, where the DNA binding preference of the polymer corresponds to the sequence binding preferences of the subunits in the particular order in which the subunits are assembled.

Another example of such a polymer is using subunits whose binding was directed at two base sections of DNA. In this case, $4^2=16$ subunits would be used, each subunit having a binding affinity for a specific two base pair sequence (e.g., AA, AC, AG, AT, CA, CC, CG, CT, GA, GC, GG, GT, TA, TC, TG, TT). If the polymers were to be comprised of subunits targeted to 3 base pair sections of DNA, then $4^3=64$ subunits would be prepared. The design of such molecular subunits is dependent upon the establishment of a refined database using empirical data derived by the method of the present invention, as described in Section VI.B.

C. Sequences Targeted by the Assay.

The DNA:protein assay of the present invention has been designed to screen for compounds that bind a full range of DNA sequences that vary in length as well as complexity. Sequence-specific DNA-binding molecules discovered by the assay have potential usefulness as either molecular reagents, therapeutics, or therapeutic precursors. Sequence-specific DNA-binding molecules are potentially powerful therapeutics for essentially any disease or condition that in some way involves DNA. Examples of test sequences for the assay include: a) binding sequences of factors involved in the maintenance or propagation of infectious agents, especially viruses, bacteria, yeast and other fungi, b) sequences causing the inappropriate expression of certain cellular genes, and c) sequences involved in the replication of rapidly growing cells. Furthermore, gene expression or replication need not necessarily be disrupted by blocking the binding of specific proteins. Specific sequences within protein-coding regions of genes (e.g., oncogenes) are equally valid test sequences since the binding of small molecules to these sequences is likely to perturb the transcription and/or replication of the region. Finally, any molecules that bind DNA with some sequence specificity, that is, not just to one particular test sequence, may be still be useful as anti-cancer agents. Several small molecules with some sequence preference are already in use as anticancer therapeutics. Molecules identified by the present assay may be particularly valuable as lead compounds for the development of congeners having either different specificity or different affinity.

One advantage of the present invention is that the assay is capable of screening for binding activity directed against any DNA sequence. Such sequences can be medically significant target sequences scrambled or randomly generated DNA sequences, or well-defined, ordered sets of DNA sequences. Other sets could be used for screening for molecules demonstrating sequence preferential binding (like Doxorubicin) to determine the sequences with highest binding affinity and/or to determine the relative affinities between a large number of different sequences. There is usefulness in taking either approach for detecting and/or designing new therapeutic agents. Section VI.C.3, "Theoretical Considerations for Choosing Target Sequences", outlines the theoretical considerations for choosing DNA target sites in a biological system.

1. Medically Significant Target Sequences.

Few effective viral therapeutics are currently available; yet several potential target sequences for antiviral DNA-binding drugs have been well-characterized. Furthermore, with the accumulation of sequence data on all biological systems, including viral genomes, cellular genomes, pathogen genomes (bacteria, fungi, eukaryotic parasites, etc.), the number of target sites for DNA-binding drugs will increase greatly in the future.

There are numerous methods for identifying medically significant target sequences for DNA-binding drugs, including, but not limited to, the following. First, medically significant target sequences are found in pathogens of the biological kingdoms, for example in genetic sequences that are key to biochemical pathways or physiological processes. Second, a target is identified, such as (i) a pathogen involved in an infectious disease, or (ii) a biochemical pathway or physiological process of a noninfectious disease, genetic condition, or other biological process. Then specific genes important for the survival of the pathogen or modulation of the endogenous pathway involved in the target system are identified. Third, specific target sequences are identified that affect the expression or activity of a DNA molecule, such as genes or sites involved in replication.

There are numerous pathogens that are potential targets for DNA-binding drugs designed using the methods described in this application. Table I lists a number of potential target pathogens.

TABLE I

| Pathogens |
| --- |
| VIRUSES |
| Retroviruses |
| Human |
| HIV I, II |
| HTLV I, II |
| Animal |
| SIV |
| STLV I |
| FELV |
| FIV |
| BLV |
| BIV (Bovine immunodeficiency virus) |
| Lentiviruses |
| Avian reticuloendotheliosis virus |
| SIV |
| STLV I |
| FELV |

TABLE I-continued

| Pathogens |
| --- |
| FIV |
| BLV |
| BIV (Bovine immunodeficiency virus) |
| Lentiviruses |
| Avian reticuloendotheliosis virus |
| Avian sarcoma and leukosis viruses |
| Caprine arthritis-encephalitis |
| Equine infectious anemia virus |
| Maedi/visna of sheep |
| MMTV (mouse mammary tumor virus) |
| Progressive pneumonia virus of sheep |
| Herpesviridae |
| Human |
| EBV |
| CMV |
| HSV I, II |
| VZV |
| HH6 |
| Cercopthecine Herpes Virus (B Virus) |
| Old world monkeys with infection into humans. |
| Animal |
| Bovine Mammillitis virus |
| Equine Herpes virus |
| Equine coital exanthema virus |
| Equine rhinopneumonitis virus |
| Infectious bovine rhinotracheitis virus |
| Marek's disease virus of fowl |
| Turkey herpesvirus |
| Hepadnaviruses |
| Human |
| HBV/HDV |
| Animal |
| Duck Hepatitis |
| Woodchucks |
| Squirrels |
| Poxviridae |
| Human |
| Orf virus |
| Cow Pox |
| Variola virus |
| Vaccinia |
| Small Pox |
| Pseudocowpox |
| Animal |
| Bovine papular stomatitis virus |
| Cowpox virus |
| Ectromelia virus (mouse pox) |
| Fibroma viruses of rabbits/squirrels |
| Fowlpox |
| Lumpy skin disease of cattle virus |
| Myxoma |
| Pseudocowpox virus |
| Sheep pox virus |
| Swine pox |
| Papovaviridae |
| Human |
| BK virus |
| SV-40 |
| JC virus |
| Human Papillomaviruses 1–58 (see list Fields) |
| Animal |
| Lymphotropic papovavirus (LPV) Monkey |
| Bovine papillomavirus |
| Shope papillomavirus |
| Adenoviridae |
| Human |
| Adenoviruses 1–4 |

TABLE I-continued

Pathogens

Animal

Canine adenoviruses 2
Parvoviridae
Human

AAV (Adeno Associated Virus)
B19 (human)
Animal

FPV (Feline parvovirus)
PPV (Porcine parvovirus)
ADV (Aleutian disease, mink)
Bovine Parvovirus
Canine Parvovirus
Feline panleukopenia virus
Minute virus of mice
Mink enteritis virus

BACTERIA

Streptococcus pneumonia
bovis
Group A Streptococci

Agents responsibie for:
Streptococcal pharyngitis
Cervical adenitis
Otitis media
Mastoiditis
Peritonsillar abscesses
Meningitis
Peritonitis
Pneumonia
Acute glomerulonephritis
Rheumatic fever
Erythema nodosum
Staphylococcus aureus
epidermidis
saprophyticus
cohnii
haemolytilcus
xylosus
warneri
capitis
hominis
silmulans
saccharolyticus
auricularis
Agents responsible for:
Furunckles
Carbuncles
Osteomyelitis
Deep tissue abscesses
Wound infections
Pneumonia
Empyema
Pericarditis
Endocarditis
Meningitis
Purulent arthritis
Enterotoxin in food poisoning
Branhamella catarrhalis
Neisseria gonorrhoea
lactamica
sicca
subflava
mucosa
flavescens
cinerea
elongata
canis TABLE I-continued Pathogens meningitides
nteric Bacilli and Similar Gram-Negative Bacteria Escherichia
Proteus
Klebsiella
Pseudomonas aeruginosa
Enterobacter
Citrobacter
Proteus
Providencia
Bacteroides
Serratia
Pseudomonas (not aeruginosa)
Acinetobacter
Salmonella
Shigella
Aeromonas
Moraxella
Edwardsiella
Ewingella
Hafnia
Kluyvera
Morganella
Plesiomonas
Pseudomonas aeruginosa
putida
pseudomallei
mallei
Haemophilus ducreyi
influenzae
parainfluenzae
Bordetella pertussis
Yersinia pestis (plague)
pseudotuberculosis
enterocolitica
Francisella tularensis
Pasteurella multocida
Vibrio cholerae
parhaemolyticus
fluvialis
furnissii
mimicus
Brucella melitensis
abortus
suis
canis
Bartonella bacilliformis
Gardnerella vaginalis
Borrelia recurrentis
hermsii
duttoni
crocidurae
burgdorferi (Lyme disease)
Bacillus anthracis
cereus
megaterium
subtilis
sphaericus
circulans
brevis
lentiformis
macerans TABLE I-continued Pathogens pumilus
thuringiensis
larvae
lentimorbus
popilliae
Streptobacillus moniliformis (rat bite fever)
Spirillum minus (rat bite fever)
Rothia dentocariosa
Kurthia
Clostridium botulinum
nouyi
bifermentans
histolyticum
ramosum
tetani
perfringens
novyi
septicum
Campylobacter jejuni
fetus
hyintestinalis
fennelliae
cinaedi
Corynebacterium ulcerans
pseudotuberculosis
JK
diphtheriae
Legionella pneumophila
bosemanii
micdadie
bosenamii
feleii
many others
Mycobacterium tuberculosis
africanum
bovis
leprae
avium complex
kansasii
fortuitum complex
scrofulaceum
marinum
ulcerans
Actinomyces
Bacteroides fragiligis
Fusobacterium necrophorum
nucleatum
Peptostreptococcus
Arachnia
Bifidobacterium
Propionibacterium
Nocardia
Treponema pallidum (syphilis)
Rickettsiae
Typhus R. prowazeki (epidemic)
R. prowazeki (Brill's disease)
R. typhi (endemic)
Spotted fever R. rickettsi
R. sibiricus TABLE I-continued Pathogens R. conorii
R. australis
R. akari
Scrub typhus R. tsutsugamushi
Q fever Coxiella burnetii
Trench fever Rochalimaea guintana
Chlamydiae C. trachomatis
(blindness, pelvic inflammatory disease, LGV)
Mycoplasma pneumoniae
Ureaplasma urealyticum
Cardiobacterium hominis
Actinobacillus actinomycetemcomitans
Kingella
Capnocytophaga
Pasteurella multocida
Leptospira interrogans
Listeria monocytogenes
Erysipelothrix rhusiopthiae
Streptobacillus moniliformis
Calymmatobacterium granulomatis
Bartonella bacilliformis
Francisella tularensis
Salmonella typhi

FUNGAL

Actinomyces israelii
naeslundii
viscosus
odontolyticus
meyeri
pyogenes
Cryptococcus neoformans
Blastomyces dermatitidis
Histoplasma capsulatum
Coccidioides immitis
Paracoccidioides brasiliensis
Candida albicans
tropicalis
(Torulopsis) glabrata
parapsilosis
Aspergillus fumigatus
flavus
niger
terreus
Rhinosporidiosis seeberi
Phycomycetes
Sporothrix schenickii
Mucorales
Entomophthorales
Agents of Chromoblastomycosis
Microsporum M. audouilni (ring worm)
M. canis
M. gypseum
Trichophyton T. schoenleinii (favus-ringworm)
T. violaceum (hair)
T. tonsurans (hair)
T. mentagrophytes (athlete's foot)

TABLE I-continued

Pathogens

T. rubrum (athlete's foot)
Malassezia furfur
Cladosporium werneckii
carrioni
Fonsecaea pedrosoi
compacta
Phialophora verrucosa
Rhinocladiella aquaspersa
Trichosporon cutaneum
Piedraia hortai
Ascomycota
Basidiomycota
Deuteromycota
Norcardia brasiliensis
caviae
asteroides

PARASITIC PATHOGENS

Plasmodium (malaria)

falcilparum
vivax
ovale
malariae
Schistosoma japonmicum
mansoni
haematobium
intercalatum
mekongi
Trypanosoma brucei gambiense
brucei rhodesiense
evansi
cruzi
equiperdum
congolense
Entamoeba histolytica
Naegleria fowleri
Acanthoamoeba astronyxis
castellanii
culbertsoni
hatchetti
palestinensis
polyphaga
rhyusodes
Leishmania dovonani
infantum
chagasi
topica
major
aethiopica
mexicana
braziliensis
peruviana
Pneumocystis carinii (interstitial pneumonia)
Babesia (tick born hemoprotozoan)

microti
divergens
Giardia lamblia
Trichomonas (venereal disease)

vaginalis
hominis

TABLE I-continued

Pathogens tenax
Cryptosporidium parvum (intestinal protozoan)
Isopora belli (dysentery)
Balantidium coli (protozoon induced dysentery)
Dientamoeba fragilis
Blastocystis hominis
Trichinella spiralis (parasitic nematode)
Wuchereria bancrofti (lymphatic filariasis)
Brugia (lymphatic filariasis)

malayi
timori
Loa Ioa (eye worm)
Onchocerca volvulus
Mansonella perstans
ozzardi
streptocerca
Dirofilaria immitis
Angiostrongylus cantonensis costaricensis
malayensis
mackerrasae
Anisakis (nematode)

simplex
typica
Pseudoterranova decipiens
Gnathostoma spinigerum
racunculus medinensis (filarial parasite, guinea worm)
Trichuris trichiura (whip worm)
Ascaris lumbricoides (nematode)
Toxocara canis (nematode round worms)
Necator americanus (heart worm)
Ancylostoma (hook worm)

duodenale
ceylanicum
americanus
members of the species Trichostrongylus
Strongyloides (intestinal nematode)

stercoralis
fuelleborni
Capillaria philippinensis (intestinal nematode)
arious species of Paragonimus (lung fluke disease)
Various species of Micorsporida
Clonorchis sinensis (liver fluke)
Fascioia (trematode, intestinal worm)

hepatica
gigantica
Fasciolopsis buski
Heterophyes heterophyes
Metagonimus yakagawa
Taenia saginata (beef tapeworm)
solium (pork tapeworm)
Hymenolepis (dwarf tapeworm)

nana
nana fraterna
diminuta
Dipylidium caninum (tapeworm of dogs and cats)
Diphyllobothrium (fish tapeworms)

lantum
dalliae
nihonkaiense
pacificum
Echinococcus (tape worm with cysts)

granulosus
multilocularis

TABLE I-continued

Pathogens vogeli
Enterobius vermicularis (Pin worm)

In addition to pathogens, many non-infectious diseases may be controlled at the level of DNA. These diseases are therefore potential candidates for treatment with DNA-binding therapeutics that are discovered or designed using the methods described in this application. Table II lists a number of potential non-infectious diseases that may be targeted for treatment using DNA-binding molecules.

TABLE II

Noninfectious Diseases

CANCER

Lung

Adenocarcinoma
Squamous cell
Small cell
Breast carcinoina
Ovarian

Serous tumors
Mucinous tumors
Endometrioid carcinoma
Endometrial carcinoma
Colon carcinoma
Malignant Melanoma
Prostate carcinoma
Lymphoma Hodgkins
Non-Hodgkin's
Leukemia Chronic Myelogenous
Acute Myelogenous
Chronic Lymphocytic
Acute Lymphocytic
Cervical carcinoma
Seminoma
Multiple Myeloma
Bladder carcinoma
Pancreatic carcinoma
Stomach carcinoma
Thyroid Papillary adenocarcinoma
Follicular carcinoma
Medullary carcinoma
Oral & Pharyngeal carcinomas
Laryngeal carcinoma
Bladder carcinoma
Renal cell carcinoma
Hepatocellular carcinoma
Glioblastoma
Astrocytoma
Meningioma
Osteosarcoma
Pheochromocytoma

CARDIOVASCULAR DISEASES

Hypertension

Essential
Malignant
Acute Myocardial Infarction
Stroke

Ischemic
Hemorrhagic

TABLE II-continued

Noninfectious Diseases

Angina Pectoris
Unstable angina
Congestive Heart Failure
Supraventricular arrhythmias
Ventricular arrhythmias
Deep Venous Thrombosis
Pulmonary Embolism
Hypercholesterolemia
Cardiomyopathy
Hypertrigiyceridemia

RESPIRATORY DISORDERS

Allergic rhinitis
Asthma
Emphysema
Chronic bronchitis
Cystic Fibrosis
Pneumoconiosis
Respiratory distress syndrome
Idiopathic pulmonary fibrosis
Primary pulmonary hypertension

GASTROINTESTINAL DISORDERS

Peptic ulcers
Cholelithiasis
Ulcerative colitis
Crohn's disease
Irritable Bowel Syndrome
Gastritis
Gilbert's syndrome
Nausea

ENDOCRINE/METABOLIC DISORDERS

Diabetes mellitus type I
Diabetes mellitus type II
Diabetes insipidus
Hypothyroidism
Hyperthyroidism
Gout
Wilson's disease
Addison's disease
Cushing's syndrome
Acromegaly
Dwarfism
Prolactinemia
Morbid obesity
Hyperparathyroidism
Hypoparathyroidism
Osteomalacia

RHEUMATOLOGY/IMMUNOLOGY DISORDERS

Transplant rejection
Systemic lupus erythematosus
Rheumatoid arthritis
Temporal Arteritis
Amyloidosis
Sarcoidosis
Sjogren's Syndrome
Scleroderma
Ankylosing spondylitis
Polymyositis
Reiter's Syndrome
Polyarteritis nodosa
Kawasaki's disease

HEMATOLOGIC DISORDERS

Anemia

Sickle cell
Sideroblastic
Hereditary spherocytosis
Aplastic
Autoimmune hemolytic anemia
Thalassemia
Disseminated intravascular coagulation
Polycythemia vera

TABLE II-continued

Noninfectious Diseases

Thrombocytopenia

Thrombotic thrombocytopenic purpura
Idiopathic thrombocytopenic purpura
Hemophilia
von Willebrand's disease
Neutropenia Post-chemotherapy
Post-radiation

NEUROLOGIC DISORDERS

Alzheimer's disease
Parkinson's disease
Myasthenia gravis
Multipie sclerosis
Amyotrophic lateral sclerosis
Epilepsy
Headaches Migraine
Cluster
Tension
Guillain-Barre syndrome
Pain (post-op, trauma)
Vertigo

PSYCHIATRIC DISORDERS

Anxiety
Depression
Schizophrenia
Substance abuse
Manic-Depression
Anorexia

DERMATOLOGIC DISORDERS

Acne
Psoriasis
Eczema
Contact dermatitis
Pruritis

OPHTHALMIC DISORDERS

Glaucoma
Allergic conjunctivitis
Macular degeneration

MUSCULOSKELETAL DISORDERS

Osteoporosis
Muscular dystrophy
Osteoarthritis

GENETIC DISORDERS

Down's syndrome
Marfan's syndrome
Neurofibromatosis
Tay-Sachs disease
Gaucher's disease
Niemann-Pick disease

GENITAL-URINARY DISORDERS

Benign prostatic hypertrophy
Polycystic kidney disease
Non-infectious glomerulonephritis
Goodpasture's syndrome
Urolithiasis
Endometriosis
Impotence
Infertility
Fertility control
Menopause Once a disease or condition is identified as a potential candidate for treatment with a DNA-binding therapeutic, specific genes or other DNA sequences that are crucial for the expression of the disease associated gene (or survival of a pathogen) are identified within the biochemical or physiological pathway (or the pathogen). In humans, many genes involved in important biological functions have been identified. Virtually any DNA sequence is a potential target site for a DNA-binding molecule, including mRNA coding sequences, promoter sequences, origins of replication, and structural sequences, such as telomeres and centromeres. One class of sites that may be preferable are the recognition sequences for proteins that are involved in the regulation or expression of genetic material. For this reason, the promoter/regulatory regions of genes also provide potential target sites (Table III, see also Example 15).

TABLE III

Human Genes with Promoter Regions that are Potential Targets for DNA-Binding Molecules

| LOCUS Names* | Locus Description |
|---|---|
| >HS5FDX | Human ferredoxin gene, 5' end. |
| >HSA1ATCA | Human macrophage alpha1-antitrypsin cap site region |
| >HSA1GPB1 | Human gene B for alpha 1-acid glycoprotein exon 1 and 5' flank |
| >HSA1MBG1 | Human gene for alpha-1-micro-globu-lin-bikunin, exons 1–5 (encoding |
| >HSA2MGLB1 | *H. sapiens* gene for alpha-2 macroglobulin, exon 1 |
| >HSACAA1 | *H. sapiens* ACAA gene (exons 1 & 2) for peroxisomal 3-oxoacyl-CoA |
| >HSACCOA | *Homo sapiens* choline acetyltransferase gene sequence. |
| >HSACEB | Human angiotensin I-converting enzyme (ACE) gene, 5' flank. |
| >HSACHG1 | Human gene fragment for the acetylcholine receptor gamma subunit |
| >HSACT2CK1 | Human cytokine (Act-2) gene, exon 1. |
| >HSACTBPR | Human beta-actin gene 5'-flanking region |
| >HSACTCA | Human cardiac actin gene, 5' flank. |
| >HSACTSA | Human gene for vascular smooth muscle alpha-actin (ACTSA), 5' |
| >HSACTSG1 | Human enteric smooth muscle gamma-actin gene, exon 1. |
| >HSAD12L | Human arachidonate 12-lipoxygenase gene, 5' end. |
| >HSADH1X | Human alcohol dehydrogenase alpha subunit (ADH1) gene, exon 1. |
| >HSADH2X | Human alcohol dehydrogenase beta subunit (ADH2) gene, exon 1. |
| >HSAFPCP | Human alpha-fetoprotein gene, complete cds. |
| >HSAK1 | Human cytosolic adenylate kinase (AK1) gene, complete cds. |
| >HSAGAL | Human alpha-N-acetylgalactosaminidase (NAGA) gene, complete cds. |
| >HSALADG | *H. sapiens* ALAD gene for porphobilinogen synthase |
| >HSALBENH | Human albumin gene enhancer region. |
| >HSALDA1 | Human aldolase A gene 5' non-coding exons |
| >HSALDCG | Human aldolase C gene for fructose-1,6-bisphosphate aldolase |
| >HSALDOA | Human aldolase A gene (EC 4.1.2.13) |
| >HSALDOBG | Human DNA for aldolase B transcription start region |
| >HSALIFA | Human leukemia inhibitory factor (LIF) gene, complete cds. |
| >HSAMINON | Human aminopeptidase N gene, complete cds. |
| >HSAMY2A1 | Human alpha-amylase (EC 3.2.1.1) gene AMY2A 5'-flank and exon 1 |
| >HSAMYB01 | Human amyloid-beta protein (APP) gene, exon 1. 1154 |
| >HSANFG1 | Human gene fragment for pronatriodilatin precursor (exons 1 and 2) |
| >HSANFPRE | Human gene for atrial natriuretic factor (hANF) precursor |
| >HSANFZ1 | Human atrial natriuretic factor gene, complete cds. |
| >HSANGG1 | Human angiotensinogen gene 5' region and exon 1 |

TABLE III-continued

Human Genes with Promoter Regions that are Potential Targets for DNA-Binding Molecules

| LOCUS Names* | Locus Description |
|---|---|
| >HSANT1 | Human heart/skeletal muscle ATP/ADP translocator (ANT1) gene, |
| >HSAPC3A | Human apolipoprotein CIII gene and apo AI-apo CIII intergenic |
| >HSAPC3G | Human gene for apolipoprotein C-III |
| >HSAPOA2 | Human gene for apolipoprotein AII |
| >HSAPOAIA | Human fetal gene for apolipoprotein AI precursor |
| >HSAPOBPRM | Human apoB gene 5' regulatory region (apolipoprotein B) |
| >HSAPOC2G | Human apoC-II gene for preproapolipoprotein C-II |
| >HSAPOCIA | Human apolipoprotein C-I (VLDL) gene, complete cds. |
| >HSAPOLIDG | H. sapiens promoter region of gene for apolipoprotein D |
| >HSARG1 | Human arginase gene exon 1 and flanking regions (EC 3.5.3.1) |
| >HSASG5E | Human argininosuccinate synthetase gene 5' end 1105 |
| >HSATP1A3S | Human sodium/potassium ATPase alpha 3 subunit (ATP1 A3) gene, 5' |
| >HSBSF2 | Human (BSF-2/IL6) gene for B cell stimulatory factor-2 |
| >HSC5GN | Human C5 gene, 5' end. 650 |
| >HSCAII | Human gene fragment for carbonic anhydrase II (exons 1 and 2) |
| >HSCALCAC | Human calcitonin/alpha-CGRP gene |
| >HSCALRT1 | Human DNA for calretinin exon 1 |
| >HSCAPG | Human cathepsin G gene, complete cds. |
| >HSCAVII1 | H. sapiens carbonic anhydrase VII (CA VII) gene, exon 1. |
| >HSCBMYHC | Human gene for cardiac beta myosin heavy chain |
| >HSCD3AA | Human complement C3 protein mRNA, 5' flank. >HSCD4 Human recognition/surface antigen (CD4) gene, 5' end. |
| >HSCD44A | Human hyaluronate receptor (CD44) gene, exon 1. |
| >HSCFTC | Human cystic fibrosis transmembrane conductance regulator gene, 5' |
| >HSCH7AHYR | Human cholesterol 7-alpha-hydroxylase (CYP7) gene, 5' end. |
| >HSCHAT | Human gene for choline acetyltransferase (EC 2.3.1.6), partial |
| >HSCHYMASE | Human mast cell chymase gene, complete cds. |
| >HSCHYMB | Human heart chymase gene, complete cds. 3279 |
| >HSCKBG | Human gene for creatine kinase B (EC 2.7.3.2) |
| >HSCNP | Human C-type natriuretic peptide gene, complete cds. |
| >HSCD59011 | Human transmembrane protein (CD59) gene, exon |
| >HSCDPRO | Human myeloid specific CD11b promoter DNA. |
| >HSCETP1 | Human cholesteryl ester transfer protein (CETP) gene, exons 1 and |
| >HSCFTC | Human cystic fibrosis transmembrane conductance regulator gene, 5' |
| >HSCOSEG | H. sapiens coseg gene for vasopres-sin-neurophysin precursor |
| >HSCREKIN | Human creatine kinase gene, exon 1. |
| >HSCRYABA | Human alpha-B-crystallin gene, 5' end. |
| >HSCS5P | Human C3 gene, 5' end. |
| >HSCSF1G1 | Human gene for colony stimulating factor CSF-1 5' region |
| >HSCSPA | Human cytotoxic serine proteinase gene, complete cds. |
| >HSCST3G | Human CST3 gene for cystatin C |
| >HSCST4 | H. sapiens CST4 gene for Cystatin D |
| >HSCYP2C8 | Human CYP2C8 gene for cytochrome P-450, 5' flank and exon 1 |
| >HSCYP45A | Human gene for cholesterol desmolase cytochrome P-450 (SCC) exon 1 |
| >HSCYPB1 | Human steroid 11-beta-hydroxylase (CYP11B1) gene, exons 1 and 2. |
| >HSCYPXI | Human CYPXI gene for steroid 18-hydroxylase (P-450 C18) . 2114 |
| >HSCYPXIB1 | Human CYPXIB gene for steroid 11be-ta-hydroxylase (P-450 11beta), |
| >HSCYPXIX | Human CYPXIX gene, exon 1 coding for aromatase P-450 (EC 1.14.14.1) |
| >HSDAFC1 | Human decay-accelerating factor (DAF) gene, exons 1 and 2. |
| >HSDBH1 | Human DNA for dopamine beta-hydroxylase exon 1 (EC 1.14.17.1) |
| >HSDES | Human desmin gene, complete cds. |
| >HSDKERB | Human cytokeratin 8 (CK8) gene, complete cds. |
| >HSDNAPOL | Human DNA polymerase alpha gene, 5' end. |
| >HSDOPAM | H. sapiens dopamine D1A receptor gene, complete exon 1, and exon 2, |
| >HSECP1 | Human DNA for eosinophil cationic protein ECP |
| >HSEGFA1 | Human HER2 gene, promoter region and exon 1. |
| >HSEL20 | Human elastin gene, exon 1. |
| >HSELAM1B | Human endothelial leukocyte adhesion molecule I (ELAM-1) gene, |
| >HSEMBPA | Human eosinophil major basic protein gene, complete cds. |
| >HSENKB1 | Human preproenkephalin B gene 5' region and exon 1 |
| >HSENO35 | Human ENO3 gene 5' end for muscle-specific enolase |
| >HSEOSDN | Human DNA for eosinophil derived neurotoxin |
| >HSEPR | Human erythropoietin receptor mRNA sequence derived from DNA, 5' |
| >HSERB2P | Human c-erb B2/neu protein gene, 5' end, and promoter region. |
| >HSERCC25 | Human genomic and mRNA sequence for ERCC2 gene 5' region involved in |
| >HSERPA | Human erythropoietin gene, complete cds. |
| >HSERR | Human mRNA for oestrogen receptor |
| >HSESTEI1 | H. sapiens exon 1 for elastase I |
| >HSFBRGG | Human gene for fibrinogen gamma chain |
| >HSFCERG5 | Human lymphocyte IgE receptor gene 5'-region (Fc-epsilon R) |
| >HSFERG1 | Human apoferritin H gene exon 1 |
| >HSFIBBR1 | Human fibrinogen beta gene 5' region and exon 1 |
| >HSFIXG | Human factor IX gene, complete cds. |
| >HSFKBP1 | Human FK506 binding proteins 12A, 12B and 12C (FKBP12) mRNA, exons |
| >HSFLAP1 | Human 5-lipoxygenase activating protein (FLAP) gene, exon 1. |
| >HSFOS | Human fos proto-oncogene (c-fos), complete cds. |
| >HSG0S2PE | Human GOS2 gene, upstream region and cds. |
| >HSGCSFG | Human gene for granulocyte colony-stimulating factor (G-CSF) |
| >HSGEGR2 | Human EGR2 gene 5' region 1233 |
| >HSGHPROM | Human growth hormone (hGH) promoter |
| >HSGIPX1 | Human gastric inhibitory polypeptide (GIP) mRNA, exon 1. |
| >HSGLA | Human GLA gene for alpha-D-galactosidase A (EC 3.2.1.22) |
| >HSGLUC1 | Human glucagon gene transcription start region 732 |
| >HSGMCSFG | Human gene for granulocyte-macrophage colony stimulating factor |
| >HSGR1 | Human glucocorticoid receptor gene, exon 1. 1602 |
| >HSGRFP1 | Human growth hormone-releasing factor (GRF) gene, exon 1 (complete) |
| >HSGSTP15 | Human GST pi gene for glutathione S-transferase pi exon 1 to 5 |
| >HSGTRH | Human gene for gonadotropin-releasing hormone |
| >HSGYPC | Human glycophorin C (GPC) gene, exon 1, and promoter region. |
| >HSH10 | Human histone (H10) gene, 5' flank. |
| >HSH1DNA | Human gene for H1 RNA 1057 |
| >HSH1FNC1 | Human H1 histone gene FNC16 promoter region |
| >HSH2B2H2 | Human H2B.2 and H2A.1 genes for Histone H2A |

TABLE III-continued

Human Genes with Promoter Regions that are Potential Targets for DNA-Binding Molecules

| LOCUS Names* | Locus Description |
|---|---|
| | and H2B |
| >HSH4AHIS | *H. sapiens* H4/a gene for H4 histone |
| >HSH4BHIS | *H. sapiens* H4/b gene for H4 histone |
| >HSHARA | Human androgen receptor gene, transcription initiation sites. |
| >HSHCG5B1 | Human chorionic gonadotropin (hCG) beta subunit gene 5 5'-flank |
| >HSHEMPRO | Human DNA for hemopoxin promoter |
| >HSHIAPPA | Human islet amyloid polypeptide (hIAPP) gene, complete cds. |
| >HSHIH4 | Human H4 histone gene |
| >HSHISH2A | Human histone H2a gene |
| >HSHISH2B | Human histone H2b gene |
| >HSHISH3 | Human histone H3 gene |
| >HSHLAA1 | Human HLA-A1 gene |
| >HSHLAB27 | Human gene for HLA-B27 antigen |
| >HSHLABW | Human HLA-Bw57 gene |
| >HSHLAF | Human HLA-F gene for human leukocyte antigen F |
| >HSHLIA | Human gene for histocompatibility antigen HLA-A3 |
| >HSHLIC | Human gene for class I histocompatibility antigen HLA-CW3 |
| >HSHMG17G | Human HMG-17 gene for non-histone chromosomal protein HMG-17 |
| >HSHOX3D | Human HOX3D gene for homeoprotein HOX3D |
| >HSHSC70 | Human hsc70 gene for 71 kd heat shock cognate protein |
| >HSHSP70D | Human heat shock protein (hsp 70) gene, complete cds. |
| >HSHSP70P | Human hsp70B gene 5'-region |
| >HSIAPP12 | Human IAPP gene exon 1 and exon 2 for islet amyloid polypeptide |
| >HSICAMAB | Human intercellular adhesion molecule 1 (ICAM-1) gene, exon 1. |
| >HSIFI54 | Human interferon-inducible gene IFI-54K 5' flank |
| >HSIFNA14 | Human interferon alpha gene IFN-alpha 14 |
| >HSIFNA16 | Human interferon alpha gene IFN-alpha 16 |
| >HSIFNA5 | Human interferon alpha gene IFN-alpha 5 |
| >HSIFNA6 | Human interferon alpha gene IFN-alpha 6 |
| >HSIFNA7 | Human interferon alpha gene IFN-alpha 7 |
| >HSIFNG | Human immune interferon (IFN-gamma) gene. |
| >HSIFNIN6 | Human alpha/beta-interferon (IFN)-inducible 6–16 gene exon 1 and |
| >HSIGF24B | Human DNA for insulin-like growth factor II (IGF-2); exon 4B |
| >HSIGFBP1A | Human insulin-like growth factor binding protein (hIGFBP1) gene |
| >HSIGK10 | Human germline gene for the leader peptide and variable region |
| >HSIGK15 | Human germline gene for the leader peptide and variable region |
| >HSIGK17 | Human rearranged gene for kappa immunoglobulin subgroup V kappa IV |
| >HSIGK20 | Human rearranged DNA for kappa immunoglobulin subgroup V kappa III |
| >HSIGKLC1 | Human germline fragment for immunoglobulin kappa light chain |
| >HSIGVA5 | Human germline immunoglobulin kappa light chain V-segment |
| >HSIL05 | Human interleukin-2 (IL-2) gene and 5'-flanking region |
| >HSIL1AG | Human gene for interleukin 1 alpha (IL-1 alpha) |
| >HSIL1B | Human gene for prointerleukin 1 beta |
| >HSIL2RG1 | Human interleukin 2 receptor gene 5' flanking region and exon 1 |
| >HSIL45 | Human interleukin 4 gene 5'-region |
| >HSIL5 | Human interleukin 5 (IL-5) gene, complete cds. |
| >HSIL6B | Human interleukin 6 (IL 6) gene, 5' flank. |
| >HSIL71 | Human interleukin 7 (1L7) gene, exon 1. |
| >HSIL9A | Human IL9 protein gene, complete cds. |
| >HSINSU | Human gene for preproinsulin, from chromosome 11. Includes a highly |
| >HSINT1G | Human int-1 mammary oncogene |
| >HSJUNCAA | Human jun-B gene, complete cds. |
| >HSKER65A | Human DNA for 65 kD keratin type II exon 1 and 5' flank |
| >HSKERUHS | Human gene for ultra high-sulphur keratin protein |
| >HSLACTG | Human alpha-lactalbumin gene |
| >HSLAG1G | Human LAG-1 gene |
| >HSLCATG | Human gene for lecithin-cholesterol acyltransferase (LCAT) |
| >HSLCK1 | Human lymphocyte-specific protein tyrosine kinase (lck) gene |
| >HSLFACD | Human leukocyte function-associated antigen-1 (LFA-1 or CD11a) |
| >HSLPLA | Human lipoprotein lipase (LPL) gene, 5' flank |
| >HSLYAM01 | Human leukocyte adhesion molecule-1 (LAM-1), exon 1. |
| >HSLYSOZY | Human lysozyme gene (EC 3.2.1.17) |
| >HSMBP1A | Human DNA for mannose binding protein 1 (MBP1), Exon 1 |
| >HSMCCPAA | Human mast cell carboxypeptidase A (MC-CPA) gene, exons 1–2. |
| >HSMDR1 | Human P-glycoprotein (MDR1) mRNA, complete cds. |
| >HSMED | Human bone marrow serine protease gene (medullasin) |
| >HSMEHG | Human DNA (exon 1) for microsomal epoxide hydrolase |
| >HSMETIE | Human metallothionein-Ie gene (hMT-Ie). |
| >HSMG01 | Human myoglobin gene (exon 1) |
| >HSMGSAG | Human gene for melanoma growth stimulatory activity (MGSA) |
| >HSMHCAG1 | Human alpha-MHC gene for myosin heavy chain N-terminus) |
| >HSMHCGE1 | Human class II invariant gamma-chain gene (5' flank, exon 1) |
| >HSMHCW5 | Human MHC class I HLA-Cw5 gene, 5' flank. |
| >HSMLN1 | Human motilin gene exon 1 |
| >HSMPOA | Human myeloperoxidase gene, exons 1–4. |
| >HSMRP | Human mitochondrial RNA-processing endoribonuclease RNA (mrp) gene |
| >HSMTS1A | *H. sapiens* mtsl gene, 5' end. |
| >HSMYCE12 | Human myc-oncogene exon 1 and exon 2 |
| >HSNAKATP | Human Na, K-ATPase beta subunit (ATP1B) gene, exons 1 and 2. |
| >HSNEURK1 | *H. sapiens* gene for neuromedin K receptor (exon 1) |
| >HSNFH1 | Human gene for heavy neurofilament subunit (NP-H) exon 1 |
| >HSNFIL6 | Human gene for nuclear factor NF-IL6 |
| >HSNFLG | Human gene for neurofilament subunit NF-L |
| >HSNK21 | Human neurokinin-2 receptor (NK-2) gene, exon 1. |
| >HSNMYC | Human germ line n-myc gene |
| >HSNRASPR | *H. sapiens* N-RAS promoter region |
| >HSODC1A | Human ornithine decarboxylase (ODC1) gene, complete cds. |
| >HSOTCEX1 | Human ornithine transcarbamylase (OTC) gene, 5'-end region. |
| >HSOTNPI | Human prepro-oxytocin-neurophysin I gene, complete cds. |
| >HSP450SCC | Human cytochrome P450scc gene, 5' end and promoter region. |
| >HSP53G | Human p53 gene for transformation related protein p53 |
| >HSPADP | Human promoter DNA for Alzheimer's disease amyloid A4 precursor |
| >HSPAI11 | Human gene for plasminogen activator inhibitor 1 (PAI-1) 5'-flank |
| >HSPGDF | Human platelet-derived growth factor A-chain (PDGF) gene, 5' end |

TABLE III-continued

Human Genes with Promoter Regions that are Potential Targets for DNA-Binding Molecules

| LOCUS Names* | Locus Description |
| --- | --- |
| >HSPGP95G | Human PGP9.5 gene for neuron-specific ubiquitin C-terminal |
| >HSPLSM | Human plasminogen gene, exon 1. |
| >HSPNMTB | Human gene for phenylethanolamine N-methylase (PNMT) (EC 2.1.1.28) |
| >HSPOMC5F | Human opiomelanocortin gene, 5' flank. |
| >HSPP14B | Human placental protein 14 (PP14) gene, complete cds. |
| >HSPRB3L | Human gene PRB3L for proline-rich protein G1 |
| >HSPRB4S | Human PRB4 gene for proline-rich protein Po, allele S |
| >HSPRLNC | Human prolactin mRNA, partial cds. |
| >HSPROAA1 | Human prothymosin-alpha gene, complete cds. |
| >HSPROT2 | Human protamine 2 gene, complete cds. |
| >HSPRPE1 | Human SPR2-1 gene for small proline rich protein (exon 1) |
| >HSPS2G1 | Human estrogen-responsive gene pS2 5' flank and exon 1 |
| >HSPSAP | Human pulmonary surfactant apoprotein (PSAP) gene, complete cds. |
| >HSPSP94A | Human gene for prostatic secretory protein PSP-94, exon 1 |
| >HSPTHRPA | Human parathyroid hormone-related peptide (PTHRP) gene, exons 1A, |
| >HSPURNPHO | Human gene for purine nucleoside phosphorylase (upstream region) |
| >HSRDNA | Human rDNA origin of transcription |
| >HSREGA01 | Human regenerating protein (reg) gene, complete cds. |
| >HSREN01 | Human renin gene 5' region and exon 1 |
| >HSRPBG1 | Human gene fragment for retinol binding protein (RBP) (exon 1–4) |
| >HSSAA1A | Human serum amyioid A (GSAA1) gene, complete cds. |
| >HSSAA1B | H. sapiens SAA1 beta gene |
| >HSSB4B1 | Human gene fragment for HLA class II SB 4-beta chain (exon 1) |
| >HSSISG5 | Human c-sis proto-oncogene 5' region |
| >HSSLIPG | Human SLPI gene for secretory leukocyte protease inhibitor |
| >HSSOD1G1 | Human superoxide dismutase (SOD-1) gene exon 1 and 5' flanking |
| >HSSODB | Human ornithine decarboxylase gene, complete cds |
| >HSSRDA01 | H. sapiens steroid 5-alpha-reductase gene, exon 1. |
| >HSSUBP1G | H. sapiens gene for substance P receptor (exon 1) |
| >HSSYB1A1 | Human synaptabrevin 1 (SYB1) gene, exon 1. |
| >HSTAT1 | Human gene for tyrosine aminotransferase (TAT) (EC 2.6.1.5) Exon 1. |
| >HSTCBV81 | Human T-cell receptor V-beta 8.1 gene 775 |
| >HSTCRB21 | Human T-cell receptor beta chain gene variable region. |
| >HSTFG5 | Human transferrin (Tf) gene 5' region |
| >HSIL3FL5 | Human interleukin 3 gene, 5' flank. |
| >HSTFPB | Human tissue factor gene, complete cds. |
| >HSTGFB1 | Human mRNA for transforming growth factor-beta (TGF-beta) |
| >HSTGFB3B | Human transforming growth factor beta-3 gene, 5' end. |
| >HSTGFBET2 | Human transforming growth factor beta-2 gene, 5' end. |
| >HSTH01 | Human tyrosine hydroxylase (TH) (EC 1.14.16.2) gene from upstream |
| >HSTHIO2A | Human metallothionein gene IIA promoter region |
| >HSTHRO01 | Human thrombospondin gene, exons 1, 2 and 3. |
| >HSTHXBG | H. sapiens gene for thyroxine-binding globulin gene |
| >HSTHYR5 | Human thyroglobulin gene 5' region |
| >HSTNFA | Human gene for tumor necrosis factor (TNF-alpha) |
| >HSTNFB | Human gene for lymphotoxin (TNF-beta) |
| >HSTOP01 | Homo sapiens type I DNA topoisomerase gene, exons 1 and 2. |
| >HSTPIA | Human triosephosphate isomerase (TPI) gene, 5' end. |
| >HSTP05 | Human thyroid peroxidase gene 5' end (EC 1.11.1.7) |
| >HSTRP | Human transferrin receptor gene promoter region |
| >HSTRPY1B | Human tryptase-I gene, complete cds. |
| >HSTUBB2 | Human beta 2 gene for beta-tubulin |
| >HSTYRO1E | Human tyrosinase gene, exon 1 and 5' flanking region (EC 1.14.18.1) |
| >HSU6RNA | Human gene for U 6 RNA |
| >HSUPA | Human uPA gene for urokinase-plasminogen activator |
| >HSVAVPO1 | Human proto-oncogene vav, 5' end. |
| >HSVCAM1A | Human vascular cell adhesion molecule-1 (VCAM1) gene, complete CDS. |
| >HSVIM5RR | Human vimentin gene 5' regulatory region |

Once the gene target or, in the case of small pathogens, the genome target has been identified, short sequences within the gene or genome target are identified as medically significant target sites. Medically significant target sites can be defined as short DNA sequences (approximately 4–30 base pairs) that are required for the expression or replication of genetic material. For example, sequences that bind regulatory factors, either transcriptional or replicatory factors, are ideal target sites for altering gene or viral expression.

Further, coding sequences may be adequate target sites for disrupting gene function, although the disruption of a polymerase complex that is moving along the DNA sequence may require a stronger binder than for the disruption of the initial binding of a regulatory protein.

Finally, even non-coding, non-regulatory sequences may be of interest as target sites (e.g., for disrupting replication processes or introducing an increased mutational frequency).

Several specific examples of medically significant target sites are shown in Table IV.

TABLE IV

MEDICALLY SIGNIFICANT DNA-BINDING SEQUENCES

| Test sequence | DNA-binding Protein | Medical Significance |
| --- | --- | --- |
| EBV origin of replication | EBNA | Infectious mononucleosis, nasal pharyngeal carcinoma |
| HSV origin of replication | UL9 | Oral and genital Herpes |
| VZV origin of replication | UL9-like | Shingles |
| HPV origin of replication | E2 | Genital warts, cervical carcinoma |
| Interleukin 2 enhancer | NFAT-1 | Immunosuppressant |
| HIV LTR | NFAT-1 NFkB | AIDS, ARC |
| HBV enhancer | HNF-1 | Hepatitis |
| Fibrogen promoter | HNF-1 | Cardiovascular disease |
| Oncogene promoter and coding | ?? | cancer |

TABLE IV-continued

MEDICALLY SIGNIFICANT DNA-BINDING SEQUENCES

| Test sequence | DNA-binding Protein | Medical Significance |
|---|---|---|
| sequences | | |

(Abbreviations: EBV, Epstein-Barr virus; EBNA, Epstein-Barr virus nuclear antigen; HSV, Herpes Simplex virus; VZV, Varicella zoster virus; HPV, human papilloma virus; HIV LTR, Human immunodeficiency virus long terminal repeat; NFAT, nuclear factor of activated T cells; NFkB, nuclear factor kappaB; AIDS acquired immune deficiency syndrome; ARC, AIDS related complex; HBV, hepatitis B virus; HNF, hepatic nuclear factor.)

For example, origin of replication binding proteins have short, well-defined binding sites within the viral genome and are therefore excellent target sites for a competitive DNA-binding drug. Examples of such proteins include, Epstein Barr virus nuclear antigen 1 (EBNA-1) (Ambinder, et al.; Reisman, et al.), E2 (which is encoded by the human papilloma virus) (Chin, et al.), UL9 (which is encoded by herpes simplex virus type 1) (McGeoch, et al.), and the homologous protein in varicella zoster virus (VZV) (Stow, et al.).

Similarly, recognition sequences for DNA-binding proteins that act as transcriptional regulatory factors are also good target sites for antiviral DNA-binding drugs. Examples listed in Table IV include (i) the binding site for hepatic nuclear factor (HNF-1), which is required for the expression of human hepatitis B virus (HBV) (Chang), and (ii) NFKB and NFAT-1 binding sites in the human immunodeficiency virus (HIV) long terminal repeat (LTR), one or both of which may be involved in the expression of the virus (Greene, W. C.).

Examples of non-viral DNA targets for DNA-binding drugs are also shown in Table IV to illustrate the wide range of potential applications for sequence-specific DNA-binding molecules. For example, nuclear factor of activated T cells (NFAT-1) is a regulatory factor that is crucial to the inducible expression of the interleukin 2 gene in response to signals from the antigen receptor, which, in turn, is required for the cascade of molecular events during T cell activation (for review, see Edwards, C. A., and Crabtree, G. R.). The mechanism of action of two immunosuppressants, cyclosporin A and FK506, is thought to be to block the inducible expression of NFAT-1 (Schmidt, et al. and Banerji, et al.). However, the effects of these drugs are not specific to NFAT-1; therefore, a drug targeted specifically to the NFAT-1 binding site in the IL-2 enhancer would be desirable as an improved immunosuppressant.

Targeting the DNA site with a DNA-binding drug rather than targeting with a drug that affects the DNA-binding protein (presumably the target of the current immunosuppressants) is advantageous for at least two reasons: first, there are many fewer target sites for specific DNA sequences than specific proteins (e.g., in the case of glucocorticoid receptor, a handful of DNA-binding sites vs. about 50,000 protein molecules in each cell); and second, only the targeted gene need be affected by a DNA-binding drug, while a proteinbinding drug would disable all the cellular functions of the protein. An example of the latter point is the binding site for HNF-1 in the human fibrinogen promoter. Fibrinogen level is one of the most highly correlated factor with cardiovascular disease. A drug targeted to either HNF-1 or the HNF-1 binding site in the fibrinogen promoter might be used to decrease fibrinogen expression in individuals at high risk for disease because of the over-expression of fibrinogen. However, since HNF-1 is required for the expression of a number of normal hepatic genes, blocking the HNF-1 protein would be toxic to liver function. In contrast, by blocking a DNA sequence that is composed in part of the HNF-1 binding site and in part by flanking sequences for divergence, the fibrinogen gene can be targeted with a high level of selectivity, without harm to normal cellular HNF-1 functions.

The assay has been designed to screen virtually any DNA sequence. Test sequences of medical significance include viral or microbial pathogen genomic sequences and sequences within or regulating the expression of oncogenes or other inappropriately expressed cellular genes. In addition to the detection of potential antiviral drugs, the assay of the present invention is also applicable to the detection of potential drugs for (i) disrupting the metabolism of other infectious agents, (ii) blocking or reducing the transcription of inappropriately expressed cellular genes (such as oncogenes or genes associated with certain genetic disorders), and (iii) the enhancement or alteration of expression of certain cellular genes.

2. Defined Sets of Test Sequences.

The approach described in the above section emphasizes screening large numbers of fermentation broths, extracts, or other mixtures of unknowns against specific medically significant DNA target sequences. The assay can also be utilized to screen a large number of DNA sequences against known DNA-binding drugs to determine the relative affinity of the single drug for every possible defined specific sequence. For example, there are $4^n$ possible sequences, where n=the number of nucleotides in the sequence. Thus, there are $4^3=64$ different three base pair sequences, $4^4=256$ different four base pair sequences, $4^5=1024$ different 5 base pair sequences, etc. If these sequences are placed in the test site, the site adjacent to the screening sequence (the example used in this invention is the UL9 binding site), then each of the different test sequences can be screened against many different DNA-binding molecules.

The test sequences may be placed on either or both sides of the screening sequence, and the sequences flanking the other side of the test sequences are fixed sequences to stabilize the duplex and, on the 3' end of the top strand, to act as an annealing site for the primer (see Example 1). In FIG. 14B, the TEST and SCREENING sequences are indicated. The preparation of such double-stranded oligonucleotides is described in Example 1 and illustrated in FIG. 4.

The test sequences, denoted in FIG. 14B as X:Y (where X=A,C,G, or T and Y=the complementary sequence, T,G,C, or A), may be any of the 256 different 4 base pair sequences shown in FIG. 13.

Once a set of test oligonucleotides containing all possible four base pair sequences has been synthesized (see Example 1), the set can be screened with any DNA-binding drug. The relative effect of the drug on each oligonucleotide assay system will reflect the relative affinity of the drug for the test sequence. The entire spectrum of affinities for each particular DNA sequence can therefore be defined for any particular DNA-binding drug. This data, generated using the assay of the present invention, can be used to facilitate molecular modeling programs and/or be used directly to design new DNA-binding molecules with increased affinity and specificity.

Another type of ordered set of oligonucleotides that may be useful for screening are sets comprised of scrambled sequences with fixed base composition. For example, if the recognition sequence for a protein is 5'-GATC-3' and libraries were to be screened for DNA-binding molecules that recognized this sequence, then it would be desirable to screen sequences of similar size and base composition as control sequences for the assay. The most precise experiment is one in which all possible 4 bp sequences are screened. In the case of a 4 base-pair sequence, this represents $4^4$=256 different test sequences: a number of screening sequences that may not be practical in every situation. However, there are many fewer possible 4 bp sequences with the same base composition (1G, 1A, 1T, 1C) (n!=24 different 4 bp sequences with this particular base composition), such sequences provide excellent: controls without having to screen large numbers of sequences.

3. Theoretical Considerations in Choosing Biological Target Sites: Specificity and Toxicity.

One consideration in choosing sequences to screen using the assay of the present invention is test sequence accessibility, that is, the potential exposure of the sequence in vivo to binding molecules. Cellular DNA is packaged in chromatin, rendering most sequences relatively inaccessible. Sequences that are actively transcribed, particularly those sequences that are regulatory in nature, are less protected and more accessible to both proteins and small molecules. This observation is substantiated by a large literature on DNAase I sensitivity, footprinting studies with nucleases and small molecules, and general studies on chromatin structure (Tullius). The relative accessibility of a regulatory sequence, as determined by DNAase I hypersensitivity, is likely to be several orders of magnitude greater than an inactive portion of the cellular genome. For this reason the regulatory sequences of cellular genes, as well as viral regulatory or replication sequences, are useful regions to choose for selecting specific inhibitory small molecules using the assay of the present invention.

Another consideration in choosing sequences to be screened using the assay of the present invention is the uniqueness of the potential test sequence. As discussed above for the nuclear protein HNF-1, it is desirable that small inhibitory molecules are specific to their target with minimal cross reactivity. Both sequence composition and length effect sequence uniqueness. Further, certain sequences are found less frequently in the human genome than in the genomes of other organisms, for example, mammalian viruses. Because of base composition and codon utilization differences, viral sequences are distinctly different from mammalian sequences. As one example, the dinucleotide CG is found much less frequently in mammalian cells than the dinucleotide sequence GC: further, in SV40, a mammalian virus, the sequences AGCT and ACGT are represented 34 and 0 times, respectively. Specific viral regulatory sequences can be chosen as test sequences keeping this bias in mind. Small inhibitory molecules identified which bind to such test sequences will be less likely to interfere with cellular functions.

There are approximately $3 \times 10^9$ base pairs (bp) in the human genome. Of the known DNA-binding drugs for which there is crystallographic data, most bind 2–5 bp sequences. There are $4^4$=256 different 4 base sequences; therefore, on average, a single 4 bp site is found roughly $1.2 \times 10^7$ times in the human genome. An individual 8 base site would be found, on average, about 50,000 times in the genome. On the surface, it might appear that drugs targeted at even an 8 bp site might be deleterious to the cell because there are so many binding sites; however, several other considerations must be recognized.

First, most DNA is tightly wrapped in chromosomal proteins and is relatively inaccessible to incoming DNA-binding molecules as demonstrated by the nonspecific endonucleolytic digestion of chromatin in the nucleus (Edwards, C. A. and Firtel, R. A.). Active transcription units are more accessible, but the most highly exposed regions of DNA in chromatin are the sites that bind regulatory factors. As demonstrated by DNAase I hypersensitivity (Gross, D. S. and Garrard, W. T.), regulatory sites may be 100–1000 times more sensitive to endonucleolytic attack than the bulk of chromatin. This is one reason for targeting regulatory sequences with DNA-binding drugs.

Secondly, several anticancer drugs that bind 2, 3, or 4 bp sequences have sufficiently low toxicity so that they can be used as drugs. This indicates that, if high affinity binding sites for known drugs can be matched with specific viral target sequences, it may be possible to use currently available drugs as antiviral agents at lower concentrations than they are currently used, with a concomitantly lower toxicity.

4. Further Considerations in Choosing Target Sites: Finding Eukaryotic Promoters.

Eukaryotic organisms have three RNA polymerases (Pol I, II, and III) that transcribe genetic information from DNA to RNA. The correct regulation of this information flow is essential for the survival of the cell. These multi-subunit enzymes need additional proteins to regulate transcription. Many of these additional proteins bind to DNA in a region 5' of the translation start site for a gene: this region is generally known as the promoter region of the gene.

All three polymerases use a core set of general transcription proteins to bind to this region. A central component of this complex is the protein called TBP or TFIID. The site this protein binds to is known as the TATA-box because the sequence usually contains a sequence motif similar to TATA (e.g., TATAa/tAa/t). Originally it was thought that each of the three polymerases used a separate set of general transcription factors and that Pol II used TFIID exclusively. Recently it has been shown that all three classes of RNA polymerase need TFIID for transcriptional regulation (see Comai, et al.; and Greenblatt).

A molecule that binds to a DNA sequence closely adjacent or overlapping a TATA binding site will likely alter transcriptional regulation of the gene. If the molecule binds based solely on specificity to the TATA-box sequence itself, then this molecule is expected to be very toxic to cells since the transcription of most genes would be altered. The sequences adjacent to TATA boxes, however, are not conserved. Accordingly, if a particular sequence is selected adjacent a TATA box of a particular gene, a molecule that binds to this specific sequence would be expected to alter the transcriptional regulation of just that gene.

TATA-boxes were first identified by determining the sequence of the DNA located 5' of the RNA start sites of a number of genes. Examination of these sequences revealed that most genes had a TATA-box motif (consensus sequence) in the range of nucleotides 50 to 15 nucleotides 5' of the RNA start site. In vitro studies, typically DNA protection (footprinting) studies, lead to the conclusion that proteins were binding to these sites. Further in vitro DNA binding experiments demonstrated that some proteins could specifically bind to these sites. This lead to assays that allowed purification and subsequent sequencing of the binding proteins. This information facilitated the cloning and expression of genes encoding the binding proteins. A large number of transcription factors are now known. The protein designated TFIID has been demonstrated to bind to the TATA-box (Lee, et al.).

Molecules that interfere with the interaction of these transcription factors and their target DNA (i.e., DNA/Protein transcription complexes) are also expected to alter transcription initiated from the target DNA. A publicly available database of these factors and the sequences to which they bind is available from the National Library of Medicine and is called "The Transcription Data Base, or TFD." The binding sites of these transcription factors can be identified in the 5' non-coding region of genes having known sequences (Example 15).

The ability to select target sequences adjacent the binding site of a transcription factor, as described above for TFIID, can be applied to other general transcription factors as well. For the purpose of the present invention, a general transcription factor is one that regulates the transcriptional expression of more than one gene. For any such general transcription factor, as for TFIID above, a particular target sequence can be selected adjacent the transcription factor binding site of a selected gene. A molecule that binds to this specific target sequence would be expected to alter the transcriptional regulation of just that gene and not all of the genes for which the transcription factor regulates expression. Alteration of transcriptional regulation may involve inhibition or increased affinity (enhancement) of binding of a transcription factor to its cognate DNA.

Many examples of such general transcription factors have been identified, including, but not limited to, the following: SP1 (Raney, et al., 1992; Kitadai, et al., 1992); NFAT-1 (Shaw, et al., 1988); Ets family of transcription factors, including Elf1 (Thompson, et al., 1992); Fos protein (Neuberg, et al., 1991); NF-kappa (Wirth, et al., 1988; Meijer, et al., 1992); and AP1-like proteins, including the product of the c-jun oncogene (Descheemaeker, et al., 1992; Ryder et al., 1988; Harshman et al., 1988; Angel et al., 1988; Bos et al., 1988; Bohmann et al., 1987).

Accordingly, for a selected gene, non-conserved DNA surrounding the transcription factor binding site can be chosen as a specific target sequence for small molecule binding. A small molecule can be chosen whose binding overlaps an adjacent transcription factor DNA binding sequence (e.g., by 1–3 nucleotide pairs). In this case, the specificity of DNA binding for the small molecule is, in large part, derived from the non-conserved sequences adjacent the transcription factor binding site, in order to reduce small molecule binding at the transcription factor binding site associated with other genes.

Small molecules that bind such specific target sequences can be identified and/or designed using the assay and methods of the present invention.

5. Further Considerations in Choosing Alternative Small-Molecule-Binding Target Sites.

Small molecules that interfere with the interaction of any DNA binding protein and its cognate DNA (i.e., DNA/Protein complexes) can be selected by the assay and methods of the present invention. As described above for general transcription factors, sequences adjacent the DNA binding site for a selected DNA binding protein can serve as a target for small molecule binding in order to alter the interaction of the DNA binding protein and its cognate site. The small molecule can affect the DNA:protein interaction, for example, by inhibiting or enhancing the association of protein with the DNA.

For a selected DNA:protein interaction, non-conserved DNA surrounding the selected DNA binding site can be chosen as a specific target sequence for small molecule binding. In some cases the small molecule binding can overlap the DNA binding site: for example, in the case of a therapeutic used to treat a mammal with a bacterial infection, a small molecule may be selected to bind to the bacterial origin of DNA replication. Such a small molecule may essentially completely overlap the region defined by the bacterial origin-of-replication-DNA:protein interaction since a corresponding target sequence is not likely present in the DNA of the mammalian host.

However, in the case where selective binding is required, as described above for TFIID, the specificity of the small molecule for DNA binding should essentially derive from the non-conserved sequences adjacent the DNA-binding protein's cognate DNA-binding site. This results in small molecule binding being reduced at similar DNA:protein binding sites at other locations.

6. Further Considerations in Choosing Target Sites: Procaryotes and Viruses.

Bacterial gene expression is regulated at several different levels, including transcription. General and specific transcription factors are needed along with the core RNA polymerase to accurately produce appropriate amounts of mRNA. Antibiotics that bind to the RNA polymerase and prevent mRNA production are potent bacterial poisons: molecules that could interfere with the initiation of transcription for specific essential genes are expected to have similar effects.

Many bacterial promoters have been sequenced and carefully examined. In general, the majority of bacterial promoters have two well characterized regions, the −35 region which has a consensus sequence similar to SEQ ID NO:625and the −10 region with a consensus sequence of SEQ ID NO:626. The sequence of the start site for RNA polymerase, however, is not always the same. The start site is determined by a supplementary protein called the sigma factor, which confers specificity for binding the RNA polymerase core. Several sigma factors are present in any species of bacteria. Each sigma factor recognizes a different set of promoter sequences. Expression of sigma factors is regulated, typically, by the growth conditions the bacteria is encountering. These sigma factor promoter sequences represent excellent targets for sequence specific DNA binding molecules.

As an example of choosing target sequences for the purpose of designing a DNA-binding therapeutic for a bacterial disease, consider the example of tuberculosis. Tuberculosis is caused by *Mycobacterium tuberculosis.*

All bacteria need to make ribosomes for the purpose of protein synthesis. The −35 and −10 regions of *M. tuberculosis* ribosome RNA synthesis has been determined. In the EMBL, locus MTRRNOP the −35 signal is located at coordinates 394 . . . 400 and the −10 signal is found at coordinates 419 . . . 422. These regions represent excellent targets for a DNA binding drug that would inhibit the growth of the bacteria by disrupting its ability to make ribosomes and synthesize protein. Multiple other essential genes could be targeted in a similar manner.

*M. tuberculosis* is a serious public health problem for several reasons, including the development of antibiotic resistant strains. Many antibiotics inhibit the growth of bacteria by binding to a specific protein and inhibiting its function. An example of this is the binding of rifampicin to the beta subunit of the bacterial RNA polymerase. Continued selection of bacteria with an agent of this kind can lead to the selection of mutants having an altered RNA polymerase so that the antibiotic can no longer bind it. Such mutants can arise from a single mutation.

However, binding a drug to a DNA regulatory region requires at least two mutations to escape the inhibitory effect of the drug: one mutation in the target DNA sequence so that the drug could not bind the target sequence, and one mutation in the regulatory binding protein so that it can recognize the new, mutated regulatory sequence. Such a double mutation event is much less frequent than the single mutation discussed above, for example, with rifampicin. Accordingly, it is expected that the development of drug resistant bacteria would be much less common for DNA-binding drugs that bind to promoter sequences.

The HIV viral promoter region (shown in FIG. 28) provides an example of choosing DNA target sequences for sequence-specific DNA binding drugs to inhibit viral replication.

Many eukaryotic viruses use promoter regions that have similar features to normal cellular genes. The replication of these viruses depends on the general transcription factors present in the host cell. As such, the promoter sequences in DNA viruses are similar to those found in cellular genes and have been well-studied. The binding factors Sp-1 and TFIID are important generalized factors that most viral promoters use.

In the HIV promoter sequence found in LOCUS HIVBH101 in version 32 of the EMBL databank, three tandem decanucleotide Sp1 binding sites are located between positions 377 and 409. Site III shows the strongest affinity for the cellular factor. The three cause up to a tenfold effect on transcriptional efficiency in vitro. The transcription start site is at position 455, with a TATA box at 427–431 in the sequence listed below. In addition to these sites, there are two NF-kappa-B sites in this region between nucleotides 350 and 373. These sites are annotated in FIG. 28.

Sequence-specific DNA binding molecules that specifically disrupted this binding would be expected to disrupt HIV replication. For example, the sequences adjacent to the TFIID binding site (SEQ ID NO:628 and/or SEQ ID NO:629), would be target: sites for a DNA-binding molecule designed to disrupt TFIID binding. These sequences are found in HIV but are not likely to occur overlapping TFIID binding sites in the endogenous human genome. Multiple sites could be targeted to decrease the likelihood that a single mutation could prevent drug binding.

D. Using Test Matrices and Pattern Matching for the Analysis of Data.

The assay described herein has been designed to use a single DNA:protein interaction to screen for sequence-specific and sequence-preferential DNA-binding molecules that can recognize virtually any specified sequence. By using sequences flanking the recognition site for a single DNA:protein interaction, a very large number of different sequences can be tested. The analysis of data yielded by such experiments displayed as matrices and analyzed by pattern matching techniques should yield information about the relatedness of DNA sequences.

The basic principle behind the DNA:protein assay of the present invention is that when molecules bind DNA sequences flanking the recognition sequence for a specific protein the binding of that protein is blocked. Interference with protein binding likely occurs by either (or both) of two mechanisms: (i) directly by stearic hindrance, or (ii) indirectly by perturbations transmitted to the recognition sequence through the DNA molecule.

Both of these mechanisms will presumably exhibit distance effects. For inhibition by direct stearic hindrance direct data for very small molecules is available from methylation and ethylation interference studies. These data suggest that for methyl and ethyl moieties, the stearic effect is limited by distance effects to 4–5 base pairs. Even still the number of different sequences that can theoretically be tested for these very small molecules is still very large (i.e., 5 base pair combinations total $4^5$ (=1024) different sequences).

In practice, the size of sequences tested can be explored empirically for different sized test DNA-binding molecules. A wide array of sequences with increasing sequence complexity can be routinely investigated. This may be accomplished efficiently by synthesizing degenerate oligonucleotides and multiplexing oligonucleotides in the assay process (i.e., using a group of different oligonucleotides in a single assay) or by employing pooled sequences in test matrices.

In view of the above, assays employing a specific protein and oligonucleotides containing the specific recognition site for that protein flanked by different sequences on either side of the recognition site can be used to simultaneously screen for many different molecules, including small molecules, that have binding preferences for individual sequences or families of related sequences. FIG. 12 demonstrates how the analysis of a test matrix yields information about the nature of competitor sequence specificity. As an example, to screen for molecules that could preferentially recognize each of the 256 possible tetranucleotide sequences (FIG. 13), oligonucleotides could be constructed that contain these 256 sequences immediately adjacent to a 11 bp recognition sequence of UL9 oriS SEQ ID NO:615, which is identical in each construct.

In FIG. 12 "+" indicates that the mixture retards or blocks the formation of DNA:protein complexes in solution and "−" indicates that the mixture had no marked effect on DNA:protein interactions. The results of this test are shown in Table V.

TABLE V

| Test Mix | Specificity |
| --- | --- |
| #1, 4, 7: oligos | none detected for the above |
| #2: for recognition site | either nonspecific or specific |
| #3 | AGCT |
| #5 | CATT or ATT |
| #6 | GCATTC, GCATT, CATTC, GCAT, or ATTC |
| #8 | CTTT |

These results demonstrate how such a matrix provides data on the presence of sequence specific binding activity is a test mixture and also provides inherent controls for non-specific binding. For example, the effect of test mix #8 on the different test assays reveals that the test mix preferentially affects the oligonucleotides that contain the sequence CCCT. Note that the sequence does not have to be within the test site for test mix #8 to exert an affect. By displaying the data in a matrix, the analysis of the sequences affected by the different: test mixtures is facilitated.

Furthermore, defined, ordered sets of oligonucleotides can be screened with a chosen DNA-binding molecule. The results of these binding assays can then be examined using pattern matching techniques to determine the subsets of sequences that bind the molecule with similar binding characteristics. If the structural and biophysical properties (such as, geometric shape and electrostatic properties) of sequences are similar, then it is likely that they will bind the molecule with similar binding characteristics. If the structural and biophysical properties of sequences are different, then it is likely that they will not bind the molecule with similar binding characteristics. In this context, the assay might be used to group defined, ordered sequences into subsets based on their binding characteristics: for example, the subsets could be defined as high affinity binding sites, moderate affinity binding sites, and low affinity binding sites. Sequences in the subsets with positive attributes (e.g., high affinity binding) have a high probability of having similar structural and biophysical properties to one another.

By screening and analyzing the binding characteristics of a number of DNA-binding molecules against the same defined set of DNA sequences, data can be accumulated about the subsets of sequences that fall into the same or similar subsets. Using this pattern matching approach, which can be computer-assisted, the sequences with similar structural and biophysical properties can by grouped empirically.

The database arising from pattern matching analysis of raw assay data will lead to the increased understanding of sequence structure and thereby lead to the design of novel DNA-binding molecules with related but different binding activities.

E. Applications for the Determination of the Sequence Specificity of DNA-Binding Drugs.

Applications for the determination of the sequence specificity of DNA-binding drugs are described below. The applications are divided into drug homo- and heteromeric polymers (part 1) and sequence-specific DNA-binding molecules as facilitators of triple strand formation (part 2).

One utility of the assay of the invention is the identification of highest affinity binding sites among all possible sites of a certain length for a given DNA-binding molecule. This information may be valuable to the design of new DNA-binding therapeutics.

1. Multimerization of Sequence-Preferential or Sequence-Specific DNA-Binding Molecules Identified in the Assay.

Any particular DNA-binding small molecule screened in the assay may only recognize a 2–4 base pair site, and even if the recognition is quite specific, the molecule may be toxic because there are so many target sites in the genome ($3 \times 10^9 / 4^4$ 4 bp sites, for example). However, if drugs with differential affinity for different sites are identified, the toxicity of DNA-binding drugs may be drastically reduced by creating dimers, trimers, or multimers with these drugs (Example 13). From theoretical considerations of the free energy changes accompanying the binding of drugs to DNA, the intrinsic binding constant of a dimer should be the square of the binding constant of the monomer (Le Pecq, J. B.). Experimental data confirmed this expectation in 1978 with dimer analogs of ethidium bromide (Kuhlmann, et al.). Dimerization of several intercalating molecules, in fact, yields compounds with DNA affinities raised from $10^5$ M$^{-1}$ for the corresponding monomer to $10^8$ to $10^9$ M$^{-1}$ for the dimers (Skorobogaty, et al.; Gaugain, et al. (1978a and b); Le Pecq, et al.; Pelaprat, et al.). Trimerization, which theoretically should yield binding affinities that are the cube of the affinity of the homomonomeric subunit or the product of affinities of the heteromonomeric subunits, has yielded compounds with affinities as high as $10^{12}$M$^{-1}$ (Laugaa, et al.). Such affinity is markedly better than the affinities seen for many DNA regulatory proteins.

As a hypothetical example, if a relatively weak DNA-binding drug, drug X, which binds a 4 bp site with an affinity of $2 \times 10^5$ M$^{-1}$ was dimerized, the bis-X drug would now recognize an 8 bp site with a theoretical affinity of $4 \times 10^{10}$ M$^{-1}$. The difference in affinity between the monomer X and the bis-X form is 200,000-fold. The number of 4 bp sites in the genome is approximately $1.2 \times 10^7$ versus the number of 8 bp sites in the genome which is approximately $5 \times 10^4$. Accordingly, there are 256-fold fewer 8 bp sites than 4 bp sites. Thus, the number of high affinity target sites is 256-fold fewer for the bis-X molecule than the number of low affinity target sites for the monomer X, with a 200,000-fold difference in affinity between the two types of sites.

Since the binding constant of a dimer is the product of the binding constants of the monomers, when monomers with higher initial binding constants are formed into dimers (or multimers) the differential effect is proportionately increased, creating a wider "window" of affinity versus the number of binding sites. The breadth of the window essentially reflects the margin of effective drug concentration compared to the relative toxicity.

There are two immediate ramifications of dimerization (or multimerization) of monomeric drugs with moderate toxicity and sequence preference. First, the concentration of drug needed is lowered because of the higher affinity, so that even relatively toxic molecules can be used as drugs. Second, since toxicity is likely linked to the average number of drug molecules bound to the genome, as specificity is increased by increasing the length of the binding site, toxicity is decreased.

Given the information already available on sequence-preferential binding of DNA-binding drugs, it is likely that each drug presented to the screening assay will have (i) a number of high affinity binding sites (e.g., 10 to 100-fold better affinity than the average site), (ii) a larger number of sites that are bound with moderate affinity (3 to 10-fold better affinity than average), (iii) the bulk of the binding sites having average affinity, and (iv) a number of sites having worse-than-average affinity. This range of binding affinities will likely resemble a bell-shaped curve. The shape of the curve will probably vary for each drug. To exemplify, assume that approximately five 4 bp sites will be high affinity binding sites, and twenty 4 bp sites will be moderately high affinity binding sites, then any given drug may recognize roughly 25, high or moderately high affinity binding sites. If 50 to 100 drugs are screened, this represents a "bank" of potentially 250–500 high affinity sites and 1000–2500 moderately high affinity sites. Thus, the probability of finding a number of high affinity drug binding sites that match medically significant target sites is good. Furthermore, heterodimeric drugs can be designed to match DNA target sites of 8 or more bp, lending specificity to the potential pharmaceuticals.

As discussed above, once the sequence preferences are known, the information may be used to design oligomeric molecules (homopolymers or heteropolymers) with substantially greater sequence specificity and substantially higher binding affinity. For example, if a DNA-binding molecule, X, binds a 4 bp sequence 5'-ACGT-3'/5'-ACGT-3' with an equilibrium affinity constant of $2 \times 10^5$ M$^{-1}$, then the dimer of X, $X_2$, should bind the dimer of the sequence, 5'-ACGTACGT-3'/5'-ACGTACGT-3', with an equilibrium affinity constant of $(2 \times 10^5$ M$^{-1})^2 = 4 \times 10^{10}$ M$^{-2}$. The DNA-binding dimer molecule, $X_2$, recognizes an 8 bp sequence, conferring higher sequence specificity, with a binding affinity that is theoretically 200,000-fold higher than the DNA-binding monomer, X.

The same argument can be extended to trimer molecules: the trimer of X, $X_3$, would bind a 12 bp sequence, 5'-ACGTACGTACGT-3'/5'-ACGTACGTACGT-3' (SEQ ID NO:642), with a theoretical equilibrium affinity constant of $8 \times 10^{15}$M$^{-2}$.

DNA-binding polymers constructed using the above-mentioned approach may be homo- or hetero-polymers of the parent compounds or oligomeric compounds composed of mixed subunits of the parent compounds. Homopolymers are molecules constructed using two or more subunits of the same monomeric DNA-binding molecule. Heteropolymers are molecules constructed using two or more subunits of different monomeric DNA-binding molecules. Oligomeric compounds are constructed of mixed pieces of parent compounds and may be hetero- or homomeric.

For example, distamycin is a member of a family of non-intercalating minor groove DNA-binding oligopeptides that are composed of repeating units of N-methylpyrrole groups. Distamycin has 3 N-methylpyrrole groups. Examples of homopolymers would be bis-distamycin, the dimer of distamycin, a molecule containing 6 N-methylpyrrole groups or tris-distamycin, the trimer of distamycin, a molecule containing 9 N-methylpyrrole groups.

Daunomycin is a member of an entirely different class of DNA-binding molecules, the anthracycline antibiotics, that bind to DNA via intercalation. Heteropolymers are molecules composed of different types of DNA-binding subunits; for example, compounds composed of a distamycin molecule linked to a daunomycin molecule or a distamycin molecule linked to two daunomycin molecules. The term "oligomeric" is being used to describe molecules comprised of linked subunits each of which may be smaller than the parent compound.

An example of an homo-oligomeric compound would be a distamycin molecule linked to 1 or 2 additional N-methylpyrrole groups; the resulting molecule would not be as large as bis-distamycin, but would fundamentally be composed of the same component organic moieties that comprise the parent molecule. Examples of a hetero-oligomeric compounds would be daunomycin linked to one or two N-methylpyrrole groups.

The construction of these polymers will be directed by the information derived from the sequence preferences of the parent compounds tested in the assay. In one embodiment of the assay, a database of preferred sequences is constructed, providing a source of information about the 4 bp sequences that bind with relatively higher affinity to particular drugs that may be linked together to target any particular larger DNA sequence.

DNA-binding subunits can be chemically coupled to form heteropolymers or homopolymers. The subunits can be joined directly to each other, as in the family of distamycin molecules, or the subunits can be joined with a spacer molecule, such as carbon chains or peptide bonds. The coupling of subunits is dependent on the chemical nature of the subunits: appropriate coupling reactions can be determined for any two subunit molecules from the chemical literature. The choice of subunits will be directed by the sequence to be targeted and the data accumulated through the methods discussed in Section VI.B of this application.

2. Sequence-Specific DNA-Binding Molecules Identified in the Assay as Facilitators of Triplex Formation.

Several types of nucleic acid base-containing polymers have been described that will form complexes with nucleic acids (for reviews, see Helene, C. and Toulme, J.-J.). One type of such a polymer forms a triple-stranded complex by the insertion of a third strand into the major groove of the DNA helix. Several types of base-recognition specific interactions of third strand oligonucleotide-type polymers have been observed. One type of specificity is due to Hoogsteen bonding (Hoogsteen). This specificity arises from recognition between pyrimidine oligcnucleotides and double-stranded DNA by pairing thymine and adenine:thymine base pairs and protonated cytosine and guanine:cytosine base pairs (Griffin, et al.). Another type of specific interaction involves the use of purine oligonucleotides for triplex formation. In these triplexes, adenine pairs with adenine:thymine base pairs and guanine with guanine:cytosine (Cooney, et al.; Beal and Dervan) or thymine:adenine base paris (Griffen, L., and Dervan, P. B.).

Other motifs for triplex formation have been described, including the incorporation of nucleic acid analogs (eg, methylphosphonates, phosphorothioates; Miller, et al.), and the invention of backbones other than the phosphoribose backbones normally found in nucleic acids (Pitha, et al.; Summerton, et al.). In several cases, the formation of triplex has been demonstrated to inhibit the binding of a DNA-binding protein (e.g., Young, et al.; Maher, et al.) or the expression of a cellular protein (Cooney, et al.).

Furthermore, several experiments have been reported in which a small DNA-binding molecule has been covalently attached to polymer capable of forming a triplex structure: (i) an acridine:polypyrimidine molecule has been demonstrated to inhibit SV40 in CV-1 cells (Birg, et al.); (ii) cleavage at a single site in a yeast chromosome was achieved with an oligonucleotide:EDTA-Fe molecule (Strobel, et al.; Dervan); and (iii) a photoinducible endonuclease was created by similar strategy by attaching an ellipticine derivative to a homopyrimidine oligonucleotide (Perouault, et al.). Several other small intercalating agents coupled to oligonucleotides have been described (for review, see Montenay-Garestier).

One utility of the assay of the present invention is to identify the sequence-specificity of DNA-binding molecules for use in designing and synthesizing heteromeric therapeutics consisting of a DNA-binding polymer (e.g., an oligonucleotide) attached to a sequence-preferential or sequence-specific DNA-binding molecule, yielding a heteropolymer. The attached small molecule may serve several functions.

First, if the molecule has increased affinity for a specific site (such as, a particular 4 base pair sequence) over all other sites of the same size, then the local concentration of the hetero-molecule, including the oligonucleotide, will be increased at those sites. The amount of heteropolymer, containing a sequence-specific moiety attached to one end, needed for treatment purposes is reduced compared to a heteropolymer that has a non-specific DNA-binding moiety attached. This reduction in treatment amount is directly proportional to both the differential specificity and the relative affinities between the sequence-specific binder and the non-specific binder. For the simplest example, if a sequence-specific molecule with absolute specificity (i.e., it binds only one sequence) had equal affinity for a specific 4 base-pair target site (1/256 possible combinations) as a non-specific molecule, then the amount of drug needed to exert the same effective concentration at that site could potentially be as much as 256-fold less for the specific and non-specific drugs. Accordingly, attaching a sequence-specific DNA-binding molecule to a polymer designed to form triplex structures allows increased localized concentrations.

A second utility of the assay of the present invention is to identify small molecules that cause conformational changes in the DNA when they bind. The formation of triplex DNA requires a shift from B form to A form DNA. This is not energetically favorable, necessitating the use of increased amounts of polymer for triplex formation to drive the conformational change. However, the insertion of a small DNA-binding molecule (such as, actinomycin D), which induces a conformational change in the DNA, reduces the amount of polymer needed to stabilize triplex formation.

Accordingly, one embodiment of the invention is to use the assay to test known DNA-binding molecules with all 256 possible four base pair test sequences to determine the relative binding affinity to all possible 4 bp sequences. Then, once the sequence preferences are known, the information may be used to design heteropolymeric molecules comprised of a small DNA-binding molecule and a macromolecule, such as a triplex-forming oligonucleotide, to obtain a DNA-binding molecule with enhanced binding characteristics. The potential advantages of attaching a sequence-specific or sequence-preferential DNA-binding small molecule to a triplex forming molecule are to (i) target the triplex to a subset of specific DNA sequences and thereby (ii) anchor the triplex molecule in the vicinity of its target sequence and in doing so, (iii) increase the localized concentration of the triplex molecule, which allows (iv) lower concentrations of triplex to be used effectively. The presence of the small molecule may also facilitate localized perturbations in DNA structure, such as destabilizing the B form of DNA, which is unsuitable for triplex formation. Such destabilization may facilitate the formation of other structures, such a form DNA useful for triplex formation. The net effect would be to decrease the amount of triplex needed for efficacious results.

F. Other Applications.

The potential pharmaceutical applications for sequence-specific DNA-binding molecules are very broad, including antiviral, antifungal, antibacterial, antitumor agents, immunosuppressants, and cardiovascular drugs. Sequence-specific DNA-binding molecules can also be useful as molecular reagents as, for example, specific sequence probes.

As more DNA-binding molecules are detected, information about their DNA binding affinities, sequence recognition, and mechanisms of DNA-binding will be gathered, eventually facilitating the design and/or modification of new molecules with different or specialized activities.

Although the assay has been described in terms of the detection of sequence-specific DNA-binding molecules, the reverse assay could be achieved by adding DNA in excess to protein to look for peptide sequence specific protein-binding inhibitors.

The following examples illustrate, but in no way are intended to limit, the present invention.

Materials and Methods

Synthetic oligonucleotides were prepared using commercially available automated oligonucleotide synthesizers. Alternatively, custom designed synthetic oligonucleotides may be purchased, for example, from Synthetic Genetics (San Diego, Calif.). Complementary strands were annealed to generate double-strand oligonucleotides.

Restriction enzymes were obtained from Boehringer Mannheim (Indianapolis Ind.) or New England Biolabs (Beverly Mass.) and were used as per the manufacturer's directions.

Distamycin A and Doxorubicin were obtained from Sigma (St. Louis, Mo.). Actinomycin D was obtained from Boehringer Mannheim or Sigma.

Standard cloning and molecular biology techniques are described in Ausubel, et al., and Sambrook, et al.

EXAMPLE 1

Preparation of the Oligonucleotide Containing the Screening Sequence

This example describes the preparation of (A) biotinylated/digoxigenin/radiolabeled, and (B) radiolabeled double-stranded oligonucleotides that contain the screening sequence and selected Test sequences.

A. Biotinylation.

The oligonucleotides were prepared as described above. The wild-type control sequence for the UL9 binding site, as obtained from HSV, is shown in FIG. 4. The screening sequence, i.e. the UL9 binding sequence, is CGTTCG-CACTT (SEQ ID NO:601) and is underlined in FIG. 4. Typically, sequences 5' and/or 3' to the screening sequence were replaced by a selected Test sequence (FIG. 5).

One example of the preparation of a site-specifically biotinylated oligonucleotide is outlined in FIG. 4. An oligonucleotide primer complementary to the 3' sequences of the screening sequence-containing oligonucleotide was synthesized. This oligonucleotide terminated at the residue corresponding to the C in position 9 of the screening sequence. The primer oligonucleotide was hybridized to the oligonucleotide containing the screening sequence. Biotin-11-dUTP (Bethesda Research Laboratories (BRL), Gaithersburg Md.) and Klenow enzyme were added to this complex (FIG. 4) and the resulting partially double-stranded biotinylated complexes were separated from the unincorporated nucleotides using either pre-prepared "G-25 SEPHADEX" spin columns (Pharmacia, Piscataway N.J.) or "NENSORB" columns (New England Nuclear) as per manufacturer's instructions. The remaining single-strand region was converted to double-strands using DNA polymerase I Klenow fragment and dNTPs resulting in a fully double-stranded oligonucleotide. A second "G-25 SEPHADEX" column was used to purify the double-stranded oligonucleotide. Oligonucleotides were diluted or resuspended in 10 mM Tris-HCl, pH 7.5, 50 mM NaCl, and 1 mM EDTA and stored at −20° C. For radiolabelling the complexes, $^{32}$P-alpha-dCTP (New England Nuclear, Wilmington, Del.) replaced dCTP for the double-strand completion step.

Alternatively, the top strand, the primer, or the fully double-stranded oligonucleotide have been radiolabeled with γ-$^{32}$P-ATP and polynucleotide kinase (NEB, Beverly, Mass.). Most of our preliminary studies have employed radiolabeled, double-stranded oligonucleotides. The oligonucleotides are prepared by radiolabeling the primer with T4 polynucleotide kinase and γ-$^{32}$P-ATP, annealing the "top" strand full length oligonucleotide, and "filling-in" with Klenow fragment and deoxynucleotide triphosphates. After phosphorylation and second strand synthesis, oligonucleotides are separated from buffer and unincorporated triphosphates using "G-25 SEPHADEX" preformed spin columns (IBI, New Haven, Conn. or Biorad, Richmond Calif.). This process is outlined in FIG. 4. The reaction conditions for all of the above Klenow reactions were as follows: 10 mM Tris-HCl, pH 7.5, 10 mM MgCl$_2$, 50 mM NaCl, 1 mM dithioerythritol, 0.33–100 μM deoxytriphosphates, 2 units Klenow enzyme (Boehringer-Mannheim, Indianapolis Ind.). The Klenow reactions were incubated at 25° C. for 15 minutes to 1 hour. The polynucleotide kinase reactions were incubated at 37° C. for 30 minutes to 1 hour.

B. End-Labeling with Digoxigenin.

The biotinylated, radiolabelled oligonucleotides or radiolabeled oligonucleotides were isolated as above and resuspended in 0.2 M potassium cacodylate (pH=7.2), 4 mM MgCl$_2$, 1 mM 2-mercaptoethanol, and 0.5 mg/ml bovine serum albumin. To this reaction mixture digoxigenin-11-dUTP (an analog of dTTP, 2'-deoxy-uridine-5'-triphosphate, coupled to digoxigenin via an 11-atom spacer arm, Boehringer Mannheim, Indianapolis Ind.) and terminal deoxynucleotidyl transferase (GIBCO BRL, Gaithersburg, Md.) were added. The number of Dig-11-dUTP moieties incorporated using this method appeared to be less than 5 (probably only 1 or 2) as judged by electrophoretic mobility on polyacrylamide gels of the treated fragment as compared to oligonucleotides of known length.

The biotinylated or non-biotinylated, digoxygenin-containing, radiolabelled oligonucleotides were isolated as above and resuspended in 10 mM Tris-HCl, 1 mM EDTA, 50 mM NaCl, pH 7.5 for use in the binding assays.

The above procedure can also be used to biotinylate the other strand by using an oligonucleotide containing the screening sequence complementary to the one shown in FIG. 4 and a primer complementary to the 3' end of that molecule. To accomplish the biotinylation Biotin-7-dATP was substituted for Biotin-11-dUTP. Biotinylation was also accomplished by chemical synthetic methods: for example, an activated nucleotide is incorporated into the oligonucleotide and the active group is subsequently reacted with NHS-LC-Biotin (Pierce). Other biotin derivatives can also be used.

C. Radiolabelling the Oligonucleotides.

Generally, oligonucleotides were radiolabelled with gamma-$^{32}$P-ATP or alpha-$^{32}$P-deoxynucleotide triphosphates and T4 polynucleotide kinase or the Klenow fragment of DNA polymerase, respectively. Labelling reactions were performed in the buffers and by the methods recommended by the manufacturers (New England Biolabs, Beverly Mass.; Bethesda Research Laboratories, Gaithersburg Md.; or Boehringer/Mannheim, Indianapolis Ind.). Oligonucleotides were separated from buffer and unincorporated triphosphates using "G-25 SEPHADEX" preformed spin columns (IBI, New Haven, Conn.; or Biorad, Richmond, Calif.) or "NENSORB" preformed columns (New England Nuclear, Wilmington, Del.) as per the manufacturers instructions.

There are several reasons to enzymatically synthesize the second strand. The two main reasons are that by using an excess of primer, second strand synthesis can be driven to near completion so that nearly all top strands are annealed to bottom strands, which prevents the top strand single strands from folding back and creating additional and unrelated double-stranded structures, and secondly, since all of the oligonucleotides are primed with a common primer, the primer can bear the end-label so that all of the oligonucleotides will be labeled to exactly the same specific activity.

EXAMPLE 2

Preparation of the UL9 Protein

A. Cloning of the UL9 Protein-Coding Sequences into pAC373.

To express full length UL9 protein a baculovirus expression system has been used. The sequence of the UL9 coding region of Herpes Simplex Virus has been disclosed by McGeoch et al. and is available as an EMBL nucleic acid sequence. The recombinant baculovirus AcNPV/UL9A, which contained the UL9 protein-coding sequence, was obtained from Mark Challberg (National Institutes of Health, Bethesda Md.). The construction of this vector has been previously described (Olivo, et al. (1988, 1989)). Briefly, the NarI/EcoRV fragment was derived from pMC160 (Wu, et al.). Blunt-ends were generated on this fragment by using all four dNTPs and the Klenow fragment of DNA polymerase I (Boehringer Mannheim, Indianapolis Ind.) to fill in the terminal overhangs. The resulting fragment was blunt-end ligated into the unique BamHI site of the baculoviral vector pAC3T3 (Summers, et al.).

B. Cloning of the UL9 Sequence in pVL1393.

The UL9 protein-coding region was cloned into a second baculovirus vector, pVL1393 (Luckow, et al.). The 3077 bp NarI/EcoRV fragment containing the UL9 gene was excised from vector pEcoD (obtained from Dr. Bing Lan Rong, Eye Research Institute, Boston, Mass.): the plasmid pEcoD contains a 16.2 kb EcoRI fragment derived from HSV-I that bears the UL9 gene (Goldin, et al.). Blunt-ends were generated on the UL9-containing fragment as described above. EcoRI linkers (10 mer) were blunt-end ligated (Ausubel, et al.; Sambrook, et al.) to the blunt-ended NarI/EcoRV fragment.

Figure 7:
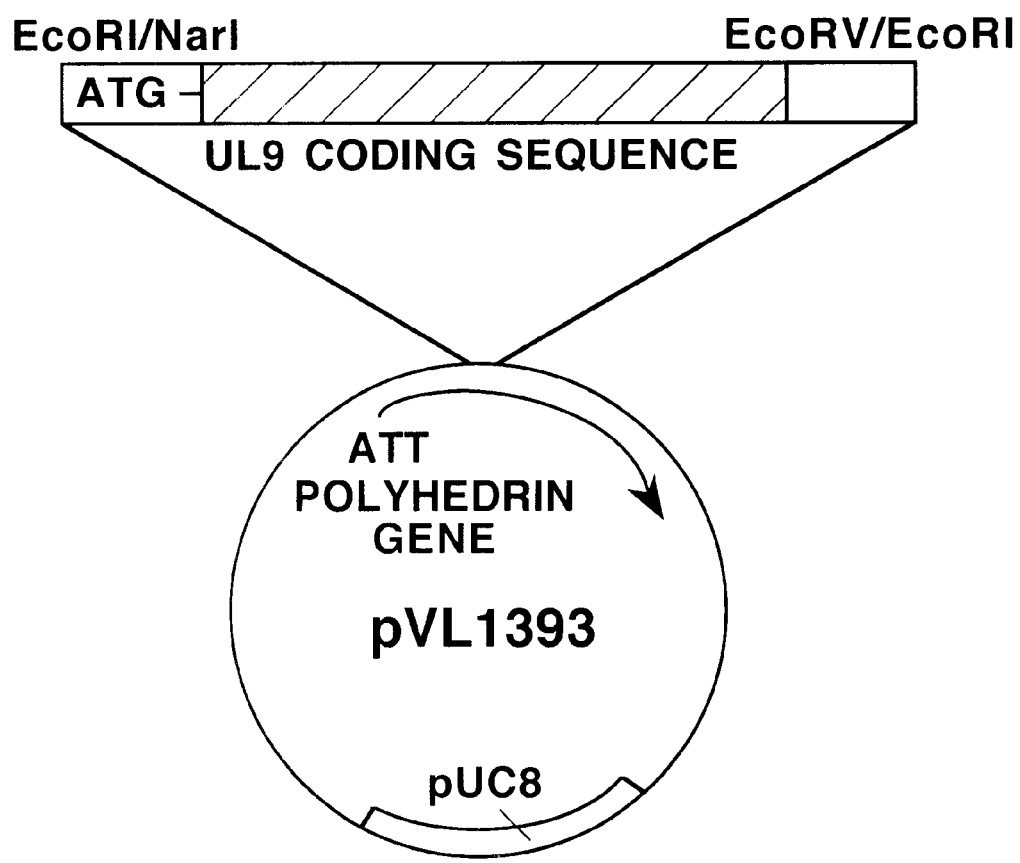
FIG. 7 shows the pVL1393 baculovirus vector containing the full length UL9 protein coding sequence.

The vector pVL1393 (Luckow, et al.) was digested with EcoRI and the linearized vector isolated. This vector contains 35 nucleotides of the 5' end of the coding region of the polyhedron gene upstream of the polylinker cloning site. The polyhedron gene ATG has been mutated to ATT to prevent translational initiation in recombinant clones that do not contain a coding sequence with a functional ATG. The EcoRI/UL9 fragment was ligated into the linearized vector, the ligation mixture transformed into *E. coli* and ampicillin resistant clones selected. Plasmids recovered from the clones were analyzed by restriction digestion and plasmids carrying the insert with the amino terminal UL9 protein-coding sequences oriented to the 5' end of the polyhedron gene were selected. This plasmid was designated pVL1393/UL9 (FIG. 7).

pVL1393/UL9 was cotransfected with wild-type baculoviral DNA (AcMNPV; Summers, et al.) into SF9 (*Spodoptera frugiperda*) cells (Summers, et al.). Recombinant baculovirus-infected Sf9 cells were identified and clonally purified (Summers, et al.).

C. Expression of the UL9 Protein.

Clonal isolates of recombinant baculovirus infected Sf9 cells were grown in Grace's medium as described by Summers, et al. The cells were scraped from tissue culture plates and collected by centrifugation (2,000 rpm, for 5 minutes, 4° C.). The cells were then washed once with phosphate buffered saline (PBS) (Maniatis, et al.). Cell pellets were frozen at −70° C. For lysis the cells were resuspended in 1.5 volumes 20 mM HEPES, pH 7.5, 10% glycerol, 1.7 M NaCl, 0.5 mM EDTA, 1 mM dithiothreitol (DTT), and 0.5 mM phenyl methyl sulfonyl fluoride (PMSF). Cell lysates were cleared by ultracentrifugation (Beckman table top ultracentrifuge, TLS 55 rotor, 34 krpm, 1 hr, 4° C.). The supernatant was dialyzed overnight at 4° C. against 2 liters dialysis buffer (20 mM HEPES, pH 7.5, 10% glycerol, 50 mM NaCl, 0.5 mM EDTA, 1 mM dtt, and 0.1 mM PMSF).

These partially purified extracts were prepared and used in DNA:protein binding experiments. If necessary extracts were concentrated using a "CENTRICON 30" filtration device (Amicon, Danvers Mass.).

D. Cloning the Truncated UL9 Protein.

Figure 6:
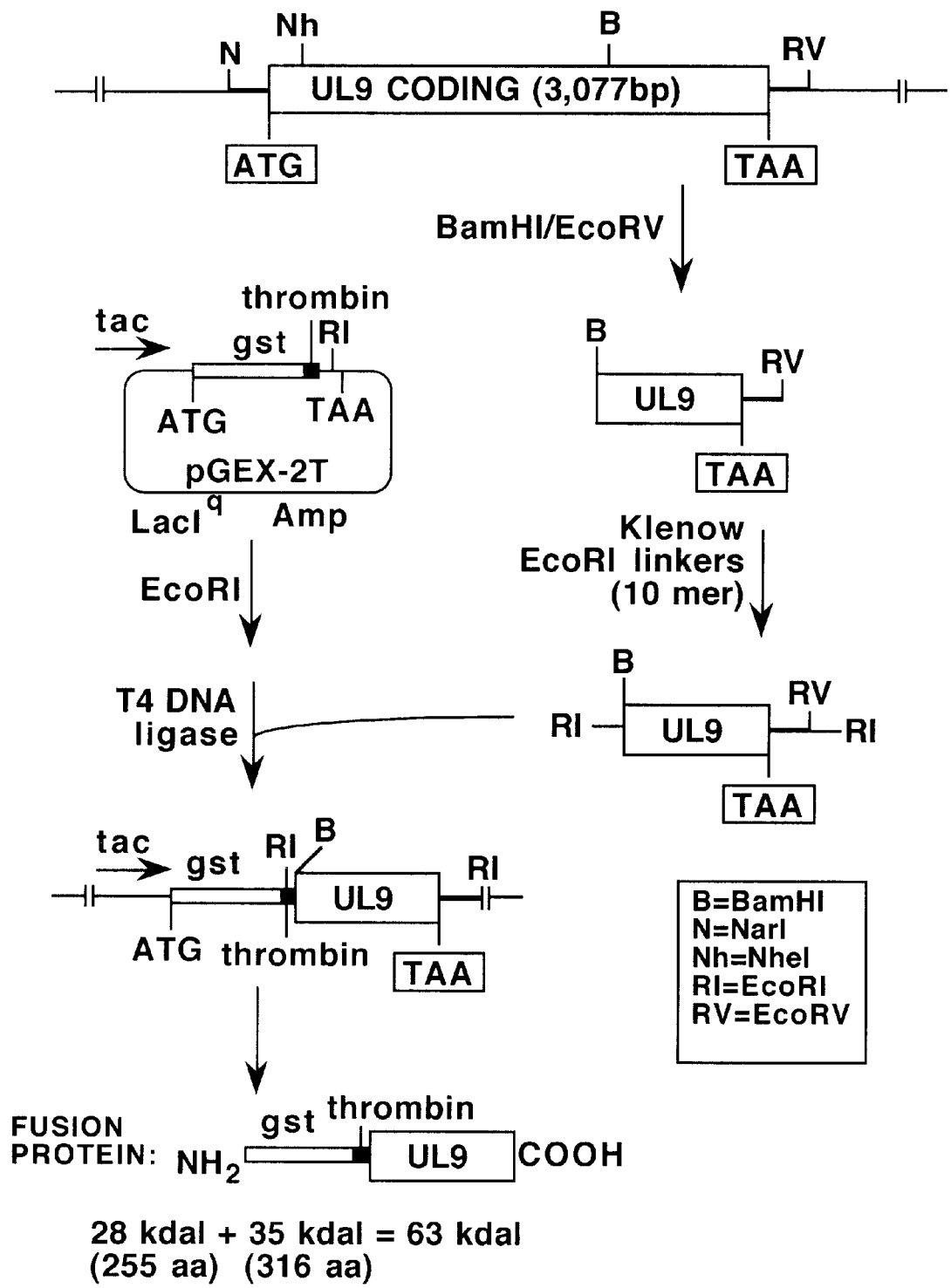
FIG. 6 outlines the clonings, into an expression vector, of a truncated form of the UL9 protein (UL9-COOH) which retains its sequence-specific DNA-binding ability.

The sequence encoding the C-terminal third of UL9 and the 3' flanking sequences, an approximately 1.2 kb fragment, was subcloned into the bacterial expression vector, pGEX-2 T (FIG. 6). The pGEX-2T is a modification of the pGEX-1 vector of Smith, et al. which involved the insertion of a thrombin cleavage sequence in-frame with the glutathione-S-transferase protein (gst).

A 1,194 bp BamHI/EcoRV fragment of pEcoD was isolated that contained a 951 bp region encoding the C-terminal 317 amino acids of UL9 and 243 bp of the 3' untranslated region.

This BamHI/EcoRV UL9 carboxy-terminal (UL9-COOH) containing fragment was blunt-ended and EcoRI linkers added as described above. The EcoRI linkers were designed to allow in-frame fusion of the UL9 protein-coding sequence to the gst-thrombin coding sequences. The Tinkered fragment was isolated and digested with EcoRI. The pGEX-2T vector was digested with EcoRI, treated with Calf Intestinal Alkaline Phc,sphatase (CIP) and the linear vector isolated. The EcoRI Tinkered UL9-COOH fragment was ligated to the linear vector (FIG. 6). The ligation mixture was transformed into E. coli and ampicillin resistant colonies were selected. Plasmids were isolated from the ampicillin resistant colonies and analyzed by restriction enzyme digestion. A plasmid which generated a gst/thrombin/UL9-COOH in frame fusion was identified (FIG. 6) and designated pGEX-2T/UL9-COOH.

E. Expression of the Truncated UL9 Protein.

E. coli strain JM109 was transformed with pGEX-2T/C-UL9-COOH and was grown at 37° C. to saturation density overnight. The overnight culture was diluted 1:10 with LB medium containing ampicillin and grown from one hour at 30° C. IPTG (isopropyllthio-β-galactoside) (GIBCO-BRL) was added to a final concentration of 0.1 mM and the incubation was continued for 2–5 hours. Bacterial cells containing the plasmid were subjected to the temperature shift and IPTG conditions, which induced transcription from the tac promoter.

Cells were harvested by centrifugation and resuspended in 1/100 culture volume of MTPBS (150 mM NaCl, 16 mM $Na_2HPO_4$, 4 mM $NaH_2PO_4$). Cells were lysed by sonication and lysates cleared of cellular debris by centrifugation.

The fusion protein was purified over a glutathione agarose affinity column as described in detail by Smith, et al. The fusion protein was eluted from the affinity column with reduced glutathione, dialyzed against UL9 dialysis buffer (20 mM HEPES pH 7.5, 50 mM NaCl, 0.5 mM EDTA, 1 mM DTT, 0.1 mM PMSF) and cleaved with thrombin (2 ng/ug of fusion protein).

An aliquot of the supernatant obtained from IPTG-induced cultures of pGEX-2T/C-UL9-COOH-containing cells and an aliquot of the affinity-purified, thrombin-cleaved protein were analyzed by SDS-polyacrylamide gel electrophoresis. The result of this analysis is shown in FIG. 8. The 63 kilodalton GST/C-UL9 fusion protein is the largest band in the lane marked GSTUL9 (lane 2). The first lane contains protein size standards. The UL9-COOH protein band (lane GST-UL9+Thrombin, FIG. 8, lane 3) is the band located between 30 and 46 kD: the glutathione transferase protein is located just below the 30 kD size standard. In a separate experiment a similar analysis was performed using the uninduced culture: it showed no protein corresponding in size to the fusion protein.

Extracts are dialyzed before use. Also, if necessary, the extracts can be concentrated typically by filtration using a "CENTRICON 30" filter.

EXAMPLE 3

Binding Assays

A. Band Shift Gels.

DNA:protein binding reactions containing both labelled complexes and free DNA were separated electrophoretically on 4–10% polyacrylamide/Tris-Borate-EDTA (TBE) gels (Fried, et al.; Garner, et al.). The gels were then fixed, dried, and exposed to X-ray film. The autoradiograms of the gels were examined for band shift patterns.

B. Filter Binding Assays.

A second method used particularly in determining the half-lives for oligonucleotide:protein complexes is filter binding (Woodbury, et al.). Nitrocellulose disks (Schleicher and Schuell, BA85 filters) that have been soaked in binding buffer (see below) were placed on a vacuum filter apparatus. DNA:protein binding reactions (see below; typically 15–30 µl) are diluted to 0.5 ml with binding buffer (this dilutes the concentration of components without dissociating complexes) and applied to the discs with vacuum applied. Under low salt conditions the DNA:protein complex sticks to the filter while free DNA passes through. The discs are placed in scintillation counting fluid (New England Nuclear), and the cpm determined using a scintillation counter.

This technique has been adapted to 96-well and 72-slot nitrocellulose filtration plates (Schleicher and Schuell) using the above protocol except (i) the reaction dilution and wash volumes are reduced, and (ii) the flow rate through the filter is controlled by adjusting the vacuum pressure. This method greatly facilitates the number of assay samples that can be analyzed. Using radioactive oligonucleotides, the samples are applied to nitrocellulose filters, the filters are exposed to x-ray film, then analyzed using a Molecular Dynamics scanning densitometer. This system transfers data directly into analytical software programs (e.g., Excel) for analysis and graphic display.

EXAMPLE 4

Functional UL9 Binding Assay

A. Functional DNA-Binding Activity Assay.

Purified protein was tested for functional activity using band-shift assays. Radiolabelled oligonucleotides (prepared as in Example 1B) that contain the 11 bp recognition sequence were mixed with the UL9 protein in binding buffer (optimized reaction conditions: 0.1 ng $^{32}$P-DNA, 1 ul UL9 extract, 20 mM HEPES, pH 7.2, 50 mM KCl, and 1 mM DTT). The reactions were incubated at room temperature for 10 minutes (binding occurs in less than 2 minutes), then separated electrophoretically on 4–10% non-denaturing polyacrylamide gels. UL9-specific binding to the oligonucleotide is indicated by a shift in mobility of the oligonucleotide on the gel in the presence of the UL9 protein but not in its absence. Bacterial extracts containing (+) or without (−) UL9 protein and affinity purified UL9 protein were tested in the assay. Only bacterial extracts containing UL9 or affinity purified UL9 protein generate the gel bandshift indicating protein binding.

The degree of extract that needed to be added to the reaction mix, in order to obtain UL9 protein excess relative to the oligonucleotide, was empirically determined for each protein preparation/extract. Aliquots of the preparation were added to the reaction mix and treated as above. The quantity of extract at which the majority of the labelled oligonucleotide appears in the DNA:protein complex was evaluated by band-shift or filter binding assays. The assay is most sensitive under conditions in which the minimum amount of protein is added to bind most of the DNA. Excess protein decreases the sensitivity of the assay with respect to the ability of inhibitors to compete with the protein for oligonucleotide binding, except when protein concentrations are so high that non-specific protein/DNA binding is provoked.

B. Rate of Dissociation.

The rate of dissociation is determined using a competition assay. An oligonucleotide having the sequence presented in FIG. 4, which contained the binding site for UL9 (SEQ ID NO:614), was radiolabelled with $^{32}$P-ATP and polynucleotide kinase (Bethesda Research Laboratories). The competitor DNA was a 17 base pair oligonucleotide (SEQ ID NO:616) containing the binding site for UL9.

In the competition assays, the binding reactions (Example 4A) were assembled with each of the oligonucleotides and placed on ice. Unlabelled oligonucleotide (1 µg) was added 1, 2, 4, 6, or 21 hours before loading the reaction on an 8% polyacrylamide gel (run in TBE buffer (Maniatis, et al.)) to separate the reaction components. The dissociation rates, under these conditions, for the truncated UL9 (UL9-COOH) and the full length UL9 is approximately 4 hours at 4° C. In addition, random oligonucleotides (a 10,000-fold excess)

that did not contain the UL9 binding sequence and sheared herring sperm DNA (a 100,000-fold excess) were tested: neither of these control DNAs competed for binding with the oligonucleotide containing the UL9 binding site.

C. Optimization of the UL9Binding Assay.

1. Truncated UL9 from the Bacterial Expression System.

The effects of the following components on the binding and dissociation rates of UL9-COOH with its cognate binding site have been tested and optimized: buffering conditions (including the pH, type of buffer, and concentration of buffer); the type and concentration of monovalent cation; the presence of divalent cations and heavy metals; temperature; various polyvalent cations at different concentrations; and different redox reagents at different concentrations. The effect of a given component was evaluated starting with the reaction conditions given above and based on the dissociation reactions described in Example 4B.

The optimized conditions used for the binding of UL9-COOH contained in bacterial extracts (Example 2E) to oligonucleotides containing the HSV ori sequence (SEQ ID NO:601) were as follows: 20 mM HEPES, pH 7.2, 50 mM KCl, 1 mM DTT, 0.005–0.1 ng radiolabeled (specific activity, approximately 108 cpm/$\mu$g) or digoxiginated, biotinylated oligonucleotide probe, and 5–10 $\mu$g crude UL9-COOH protein preparation (1 mM EDTA is optional in the reaction mix). Under optimized conditions, UL9-COOH binds very rapidly and has a dissociation rate of about 4 hours at 4° C. with non-biotinylated oligonucleotide and 5–10 minutes with biotinylated oligonucleotides. The dissociation rate of UL9-COOH changes markedly under different physical conditions. Typically, the activity of a UL9 protein preparation was assessed using the gel band-shift assay and related to the total protein content of the extract as a method of standardization. The addition of herring sperm DNA depended on the purity of UL9 used in the experiment Binding assays were incubated at 25° C. for 5–30 minutes.

2. Full Length UL9 Protein from the Baculovirus System.

The binding reaction conditions for the full length baculovirus-produced UL9 polypeptide have also been optimized. The optimal conditions for the current assay were determined to be as follows: 20 mM Hepes; 100 mM NaCl; 0.5 mM dithiothreitol; 1 mM EDTA; 5% glycerol; from 0 to $10^4$-fold excess of sheared herring sperm DNA; 0.005–0.1 ng radiolabeled (specific activity, approximately $10^8$ cpm/$\mu$g) or digoxiginated, biotinylated oligonucleotide probe, and 5–10 pg crude UL9 protein preparation. The full length protein also binds well under the optimized conditions established for the truncated UL9-COOH protein.

EXAMPLE 5

Figure 9A:
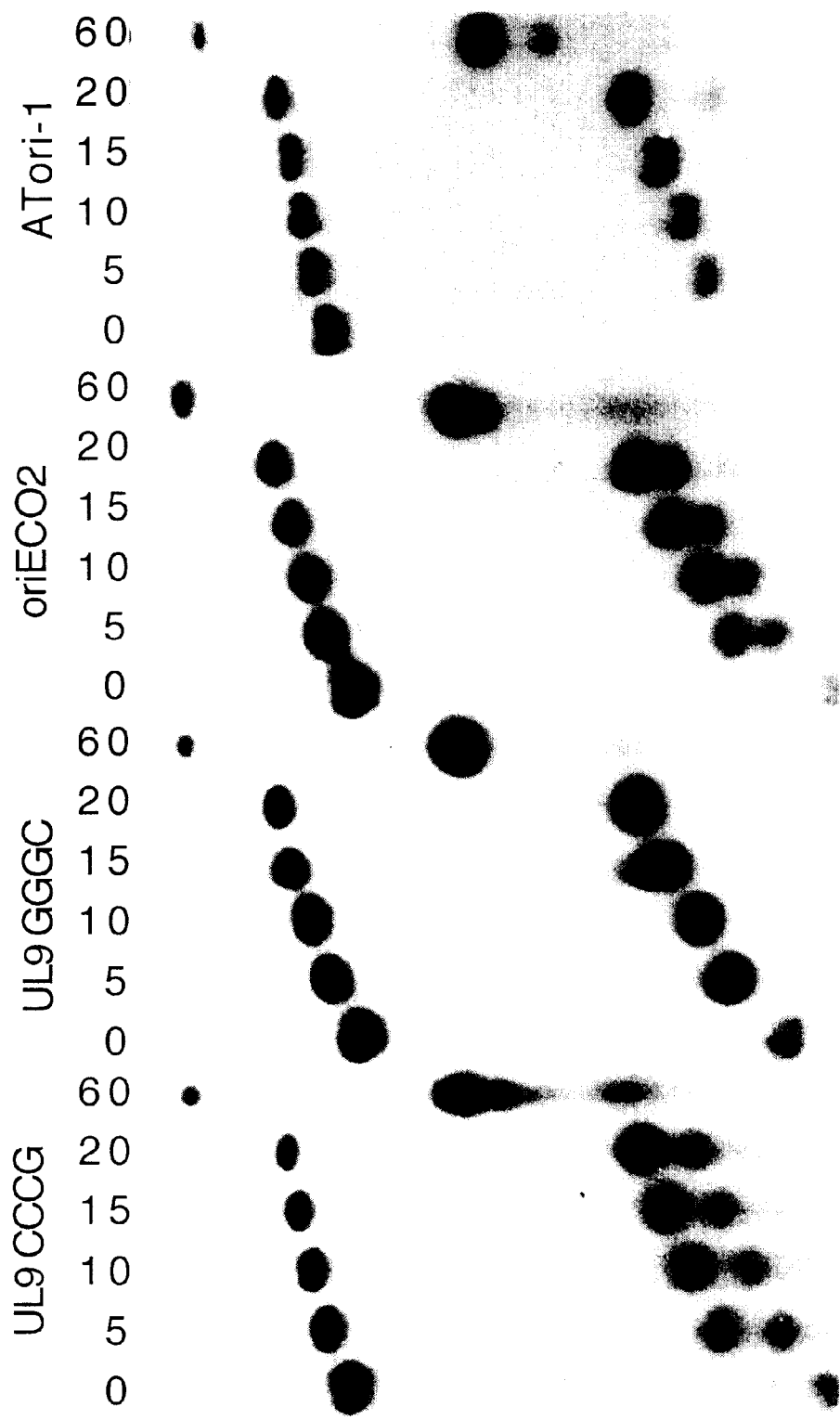
FIGS. 9A–9B presents data demonstrating the effect on UL9-COOH binding of alterations in the test sequences that flank the UL9 screening sequence.
Figure 9B:
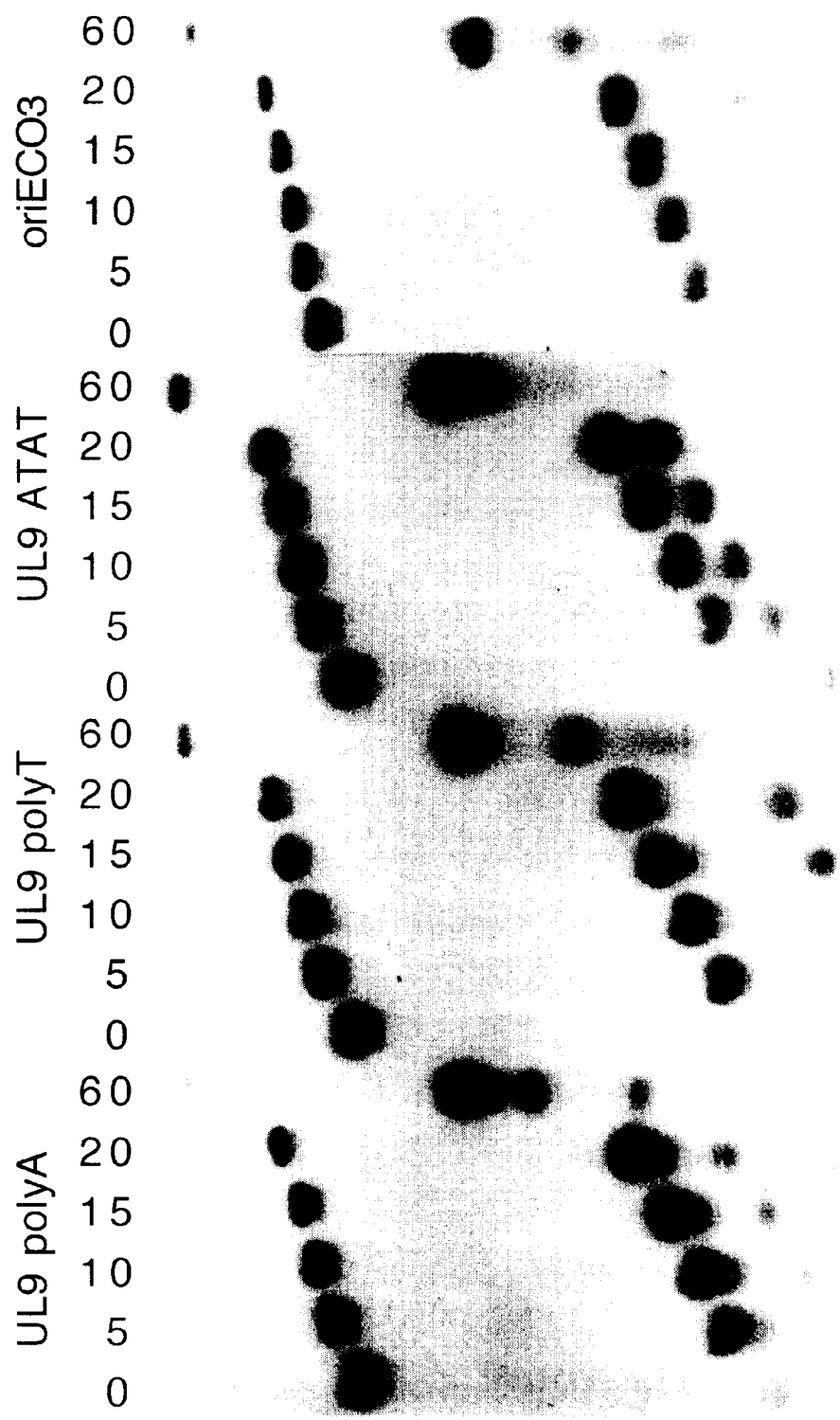

The Effect of Test Sequence Variation on the Half-Life of the UL9 DNA:Protein Complex The oligonucleotides shown in FIG. 5 were radiolabelled as described above. The competition assays were performed as described in Example 4B using UL9-COOH. Radiolabelled oligonucleotides were mixed with the UL9-COOH protein in binding buffer (typical reaction: 0.1 ng oligonucleotide $^{32}$P-DNA, 1 $\mu$l UL9-COOH extract, 20 mM HEPES, pH 7.2, 50 mM KCl, 1 mM EDTA, and 1 mM DTT). The reactions were incubated at room temperature for 10 minutes. A zero time point sample was then taken and loaded onto an 8% polyacrylamide gel (run use TBE). One $\mu$g of the unlabelled 17 bp competitive DNA oligonucleotide (SEQ ID NO:616) (Example 4B) was added at 5, 10, 15, 20, or 60 minutes before loading the reaction sample on the gel. The results of this analysis are shown in FIG. 9: the screening sequences that flank the UL9 binding site (SEQ ID NO:605-SEQ ID NO:613) are very dissimilar but have little effect on the off-rate of UL9. Accordingly, these results show that the UL9 DNA binding protein is effective to bind to a screening sequence in duplex DNA with a binding affinity that is substantially independent of test sequences placed adjacent the screening sequence. Filter binding experiments gave the same result.

EXAMPLE 6

The Effect of Actinomycin D, Distamycin A, and Doxorubicin on UL9 Binding to the Screening Sequence is Dependent on the Specific Test Sequence Different oligonucleotides, each of which contained the screening sequence (SEQ ID NO:601) flanked on the 5' and 3' sides by a test sequence (SEQ ID NO:605 to SEQ ID NO:613), were evaluated for the effects of distamycin A, actinomycin D, and doxorubicin on UL9-COOH binding.

Binding assays were performed as described in Example 5. The oligonucleotides used in the assays are shown in FIG. 5. The assay mixture was allowed to pre-equilibrate for 15 minutes at room temperature prior to the addition of drug.

A concentrated solution of Distamycin A was prepared in dH$_2$O and was added to the binding reactions at the following concentrations: 0, 1 $\mu$M, 4 $\mu$M, 16 $\mu$M, and 40 $\mu$M. The drug was added and incubated at room temperature for 1 hour. The reaction mixtures were then loaded on an 8% polyacrylamide gel (Example 5) and the components separated electrophoretically. Autoradiographs of these gels are shown in FIG. 10A. The test sequences tested were as follows: UL9 polyT, SEQ ID NO:609; UL9 CCCG, SEQ ID NO:605; UL9 GGGC, SEQ ID NO:606; UL9 polyA, SEQ ID NO:608; and UL9 ATAT, SEQ ID NO:607. These results demonstrate that Distamycin A preferentially disrupts binding to UL9 polyT, UL9 polyA and UL9 ATAT.

A concentrated solution of Actinomycin D was prepared in dH$_2$O and was added to the binding reactions at the following concentrations: 0 $\mu$M and 50 $\mu$M. The drug was added and incubated at room temperature for 1 hour. Equal volumes of dH$_2$O were added to the control samples. The reaction mixtures were then loaded on an 8% polyacrylamide gel (Example 5) and the components separated electrophoretically. Autoradiographs of these gels are shown in FIG. 10B. In addition to the test sequences tested above with Distamycin A, the following test sequences were also tested with Actinomycin D: ATori1, SEQ ID NO:611; oriEco2, SEQ ID NO:612, and oriEco3, SEQ ID NO:613. These results demonstrate that actinomycin D preferentially disrupts the binding of UL9 to the oligonucleotides UL9 CCCG and UL9 GGGC.

A concentrated solution of Doxorubicin was prepared in dH$_2$O and was added to the binding reactions at the following concentrations: 0 $\mu$M, 15 $\mu$M and 35 $\mu$M. The drug was added and incubated at room temperature for 1 hour. Equal volumes of dH$_2$O were added to the control samples. The reaction mixtures were then loaded on an 8% polyacrylamide gel (Example 5) and the components separated electrophoretically. Autoradiographs of these gels are shown in FIG. 10C. The same test sequences were tested as for Actinomycin D. These results demonstrate that Doxorubicin preferentially disrupts the binding of UL9 to the oligonucleotides UL9 polyT, UL9 GGGC, oriEco2, and oriEco3. Doxorubicin appears to particularly disrupt the UL9:screening sequence interaction when the test sequence oriEco3 is used. The sequences of the test sequences for oriEco2 and oriEco3 differ by only one base: an additional T residue inserted at position 12, compare SEQ ID NO:612 and SEQ ID NO:613.

EXAMPLE 7

Use of the Biotin/Streptavidin Reporter System

A. The Capture of Protein-Free DNA.

Several methods have been employed to sequester unbound DNA from DNA:protein complexes.

1. Magnetic Beads.

Streptavidin-conjugated superparamagnetic polystyrene beads (Dynabeads M-280 Streptavidin, Dynal AS, 6–7×10$^8$ beads/ml) are washed in binding buffer then used to capture biotinylated oligonucleotides (Example 1). The beads are added to a 15 ul binding reaction mixture containing binding buffer and biotinylated oligonucleotide. The beads/oligonucleotide mixture is incubated for varying lengths of time with the binding mixture to determine the incubation period to maximize capture of protein-free biotinylated oligonucleotides. After capture of the biotinylated oligonucleotide, the beads can be retrieved by placing the reaction tubes in a magnetic rack (96-well plate magnets are available from Dynal). The beads are then washed.

2. Agarose Beads.

Biotinylated agarose beads (immobilized D-biotin, Pierce, Rockford, Ill.) are bound to avidin by treating the beads with 50 $\mu g/\mu l$ avidin in binding buffer overnight at 4° C. The beads are washed in binding buffer and used to capture biotinylated DNA. The beads are mixed with binding mixtures to capture biotinylated DNA. The beads are removed by centrifugation or by collection on a non-binding filter disc.

For either of the above methods, quantification of the presence of the oligonucleotide depends on the method of labelling the oligonucleotide. If the oligonucleotide is radioactively labelled: (i) the beads and supernatant can be loaded onto polyacrylamide gels to separate DNA:protein complexes from the bead:DNA complexes by electrophoresis, and autoradiography performed; (ii) the beads can be placed in scintillation fluid and counted in a scintillation counter. Alternatively, presence of the oligonucleotide can be determined using a chemiluminescent or colorimetric detection system.

B. Detection of Protein-Free DNA.

The DNA is end-labelled with digoxigenin-11-dUTP (Example 1). The antigenic digoxigenin moiety is recognized by an antibody-enzyme conjugate, anti-digoxigenin-alkaline phosphatase (Boehringer Mannheim Indianapolis Ind.). The DNA/antibody-enzyme conjugate is then exposed to the substrate of choice. The presence of dig-dUTP does not alter the ability of protein to bind the DNA or the ability of streptavidin to bind biotin.

1. Chemiluminescent Detection.

Digoxigenin-labelled oligonucleotides are detected using the chemiluminescent detection system "SOUTHERN LIGHTS" developed by Tropix, Inc. (Bedford, Mass.). Use of this detection system is illustrated in FIGS. 11A and 11B. The technique can be applied to detect DNA that has been captured on either beads or filters.

Biotinylated oligonucleotides, which have terminal digoxygenin-containing residues (Example 1), are captured on magnetic (FIG. 11A) or agarose beads (FIG. 11B) as described above. The beads are isolated and treated to block non-specific binding by incubation with I-Light blocking buffer (Tropix) for 30 minutes at room temperature. The presence of oligonucleotides is detected using alkaline phosphatase-conjugated antibodies to digoxygenin. Anti-digoxigenin-alkaline phosphatase (anti-dig-AP, 1:5000 dilution of 0.75 units/ul, Boehringer Mannheim) is incubated with the sample for 30 minutes, decanted, and the sample washed with 100 mM Tris-HCl, pH 7.5, 150 mM NaCl. The sample is pre-equilibrated with 2 washes of 50 mM sodium bicarbonate, pH 9.5, 1 M MgCl$_2$, then incubated in the same buffer containing 0.25 mM 3-(2'-spiroadamantane)-4-methoxy-4-(3'-phosphoryloxy) phenyl-1,2-dioxetane disodium salt (AMPPD) for 5 minutes at room temperature. AMPPD was developed (Tropix Inc.) as a chemiluminescent substrate for alkaline phosphatase. Upon dephosphorylation of AMPPD the resulting compound decomposes, releasing a prolonged, steady emission of light at 477 nm.

Excess liquid is removed from filters and the emission of light occurring as a result of the dephosphorylation of AMPPD by alkaline phosphatase can be measured by exposure to x-ray film or by detection in a luminometer.

In solution, the bead-DNA-anti-dig-AP is resuspended in "SOUTHERN LIGHT" assay buffer and AMPPD and measured directly in a luminometer. Large scale screening assays are performed using a 96-well plate-reading luminometer (Dynatech Laboratories, Chantilly, Va.). Subpicogram quantities of DNA (10$^2$ to 10$^3$ attomoles (an attomole is 10$^{-18}$ moles)) can be detected using the Tropix system in conjunction with the plate-reading luminometer.

2. Colorimetric Detection.

Standard alkaline phosphatase colorimetric substrates are also suitable for the above detection reactions. Typically substrates include 4-nitrophenyl phosphate (Boehringer Mannheim). Results of colorimetric assays can be evaluated in multiwell plates (as above) using a plate-reading spectrophotometer (Molecular Devices, Menlo Park Calif.). The use of the light emission system is more sensitive than the colorimetric systems.

EXAMPLE 8

Labelling Test Oligonucleotides to Equivalent Specific Activities

The top strands of 256 oligonucleotides, containing all possible 4 bp sequences in the test sites flanking the UL9 recognition site, were synthesized. The oligonucleotides were composed of identical sequences except for the 4 bp sites flanking either side of the UL9 recognition sequence (SEQ ID No:601). The oligonucleotides had the general sequence presented in FIG. 14B (SEQ ID NO:617), where XXXX is the test sequence and N=A,G,C, or T. A 12 bp primer sequence, which is the complementary sequence to the 3'-end of the test oligonucleotide, was also synthesized: the primer was designated the HSV primer and is presented as SEQ ID NO:618.

The HSV primer was used to prime second strand synthesis and to facilitate labeling the oligonucleotides to the same specific activity. Oligonucleotide labelling was accomplished by labeling the 5' end of the HSV primer and then using the same primer to prime second strand synthesis of all 256 test oligonucleotides. The 5' end of the primer can be labeled with radioisotopes such as $^{32}$P, $^{33}$P, or $^{35}$S, or with non-radioactive detection systems such as digoxygenin or biotin as discussed in the Capture/Detection section.

Radioactive-labeling of the primer with $^{32}$P is accomplished by the enzymatic transfer of a radioactive phosphate from γ-$^{32}$P-ATP to the 5' end of the primer oligonucleotide using T4 polynucleotide kinase (Ausubel, et al.). For labeling 256 oligonucleotides, approximately 60 $\mu g$ HSV primer was labeled as follows. The oligonucleotide was incubated for 1 hour at 37° C. with 125 µl γ-$^{32}$P-ATP (20 mCi total, 7000 Ci/mmol) and 600 units of T4 polynucleotide kinase in a 3 ml reaction volume containing 50 mM Tris-HCL, pH 7.5, 10 mM MgCl$_2$, 10 mM spermidine, and 1.5 mM dithiothreitol (freshly prepared). To stop the reaction, EDTA was added to a final concentration of 20 mM. Unincorporated nucleotides were removed using "G-25 SEPHADEX" chromatography in 10 mM Tris-HCL, pH 7.5, 50 mM NaCl, and 1 mM EDTA (TE+50).

The radioactive primer was individually annealed to the top strand of each of the 256 test oligonucleotides. The bottom strand is synthesized using deoxyribonucleotides and Klenow fragment or T4 polymerase (Ausubel, et al.). The annealing mixture typically contained 200 ng HSV primer mixed with 1 µg top strand in 20 mM Tris-HCL, pH 7.5, 1 mM spermidine, and 0.1 mM EDTA (35 µl reaction volume). The primer was annealed to the top strand by incubating the sample for 2 minutes at 70° C., then placing the sample at room temperature or on ice. To the annealing mixture, 4.5 µl 10×Klenow buffer (10×=200 mM Tris-HCL, 500 mM NaCl, 50 mM MgCl$_2$, 10 mM dithiothreitol), 5 µl 0.5 mM each dNTP (dATP, dCTP, dGTP, dTTP), and 1 µl Klenow fragment were added. This reaction mixture was incubated 30–60 minutes at room temperature (or up to 37° C.).

The volume of the reaction mixture was increased by adding 75 µl a solution of 10 mM Tris-HCl, pH 7.5, 50 mM NaCl, and 10 mM EDTA. The reaction mixture was applied to a 1 ml "G-25 SEPHADEX" (in TE+50) spin column. The spin columns were prepared by plugging 1 cc tuberculin syringes with silanized glass wool and adding a slurry of "G-25 SEPHADEX." The columns were prespun at 2000 rpm in a tabletop centrifuge for 4 minutes. The samples (reaction mixtures) were passed through the column by centrifugation (2000 rpm, 4 minutes at room temperature) to remove unincorporated deoxyribonucleotides. The incorporation of $^{32}$P was measured by placing a small volume of the sample in scintillation fluor and determining the disintegrations per minute (dpms) in a scintillation counter.

The radiolabeled double-stranded oligonucleotides were then diluted to the same specific activity (equal dpms per volume). Typically, a concentration of 0.1 to 1 ng/µl oligonucleotide was used in the assay.

The same procedure can be used for second strand synthesis and labeling to equal specific activity regardless of the type of label on the HSV primer.

EXAMPLE 9

An Arrayed Sample Format

Screening large numbers of test molecules or test sequences is most easily accomplished in an arrayed sample format, for example, a 96-well plate format. Such formats are readily amenable to automation using robotics systems. Several different types of disposable plastic plates are available for use in screening assays including the following: polyvinyl chloride (PVC), polypropylene (PP), polyethylene (PE), and polystyrene (PS) plates. Plates, or any testing vehicle in which the assay is performed, are tested for protein and DNA adsorption and coated with a blocking reagent if necessary.

One method for testing protein or DNA adsorption to plates is to place assay mixtures in the wells of the plates for varying lengths of time. Samples are then removed from the wells and a nitrocellulose dot blot capture system (Ausubel, et al.; Schleicher and Schuell) is used to measure the amount of DNA:protein complex remaining in the mixture over time.

When radiolabeled oligonucleotides are used for the test, signal can be measured using autoradiography and a scanning laser densitometer. A decrease in the amount of DNA:protein complex in the absence of competitor molecules is indicative of plate adsorption. If plate adsorption occurs, the plates are coated with a blocking agent prior to use in the assay.

None of the plates listed above showed marked adsorption at a 30 minute time point under the conditions of the assay. However, most plates, regardless of brand, showed significant adsorption at times greater than 2 hours.

Coating the plates with a blocking agent decreases variability in the assay. Several types of blocking reagents typically used to block the adsorption of macromolecules to plastic are known, primarily from immunoscreening procedures. For example, plates may be blocked with either 1% bovine serum albumin (BSA) in phosphate-buffered saline (PBS), or 0.1% gelatin, 0.05% "TWEEN29" in PBS.

To test for the effectiveness of using such blocking reagents, the plates were treated with the above reagents for 1 hour at room temperature, then washed three times with 0.05% "TWEEN20" in PBS and once with the assay buffer. Assay reaction mixtures were aliquoted to the plates and tested as described above using dot blot capture assays. Both of the blocking reagents (BSA or gelatin) were effective in blocking DNA and protein binding—except when polypropylene plates were used. Based on these experiments, PVC plates blocked with BSA were determined to work well in the assay of the present invention.

Plates were tested for inter- and intra-plate variability by aliquoting duplicate samples to all 96-wells of several plates, and determining the amount of DNA:protein complex recovered using the dot blot/nitrocellulose system. The coefficient of variation [%CV=(the standard deviation/mean)*100] was calculated for intra-plate variability (i.e., between samples on the same plate) and inter-plate variability (i.e., between plates). Blocked PVC plates showed an intra-plate %CV of 5–20%; inter-plate variability was about 8%.

EXAMPLE 10

Sequence Selectivity and Relative Binding Affinity for Distamycin

Using the assay method of the present invention, distamycin was tested for sequence selectivity and relative binding affinity to 256 different 4 bp sequences.

A. The Assay Mixture.

Water, buffer and UL9 were mixed on ice and aliquoted to the wells of a 96-well plate. The addition of water/UL9/buffer mix was accomplished with an 8-channel repipettor, which holds a relatively large volume and allowed rapid, accurate pipetting to all 96 wells of a master experimental plate.

Radiolabeled double-stranded oligonucleotides were aliquoted from 96-well master stock plates (containing the array of all 256 oligonucleotides diluted to the same specific activity) to the wells of the master experimental plates.

Master assay mixtures in the master experimental plates were thoroughly mixed by pipetting up and down. The mixtures were aliquoted to the test plates. Each test plate typically included one sample as a control (no test molecules added) and as many test samples as were needed for different test molecules or test molecule concentrations. There were 3 master oligonucleotide stock plates, containing the array of 256 oligonucleotides. Accordingly, an experiment testing distamycin at different concentrations would require 256 control assays (one for each oligonucleotide) and 256 assays at each of the drug concentrations to be tested.

The following assay mixture was used for testing distamycin in the assay of the present invention: 1.5 nM radio-labeled DNA and 12.8 nM UL9-COOH protein (prepared as described above in the UL9 binding buffer; 20 mM Hepes, pH 7.2, 50 mM KCl, and 1 mM dithiothreitol). The concentration of the components in the assay mixture can be varied as described above in the Detailed Description.

Assay mixtures containing both UL9 and DNA were incubated at room temperature for at least 10 minutes to allow the DNA:protein complexes to form and for the system to come to equilibrium. At time=0, the assay was begun by adding water (control samples) or distamycin (5–15 µM, test samples) to the assay mixtures using a 12-channel micropipettor. After incubation with drug for 5–120 minutes, samples were taken and applied to nitrocellulose on a 96-well dot blot apparatus (Schleicher and Schuell). The samples were held at 4° C.

Tests were performed in duplicate. Typically, one set of 256 test oligonucleotides was scrambled with respect to location on the 96-well plate to eliminate any effects of plate location.

B. The Capture/Detection System.

A 96-well dot blot apparatus was used to capture the DNA:protein complexes on a nitrocellulose filter. The filters used in the dot blot apparatus were pretreated as follows. The nitrocellulose filter was pre-wetted with water and soaked in UL9 binding buffer. The filter was then placed on 1 to 3 pieces of 3 MM filter paper, which were also presoaked in UL9 binding buffer. All filters were chilled to 4° C. prior to placement in the apparatus.

Prior to the application of the assay sample to the wells of the dot-blot apparatus, the wells were filled with 375 µl of UL9 binding buffer. Typically, 5–50 µl of sample (usually 10–15 µl) were pipetted into the wells containing binding buffer and a vacuum applied to the system to pull the sample through the nitrocellulose. Unbound DNA passes through the nitrocellulose, protein-bound DNA sticks to the nitrocellulose. The filters were dried and exposed to X-ray film to generate autoradiographs.

C. Quantitation of Data.

The autoradiographs of the nitrocellulose filters were analyzed with a Molecular Dynamics (Sunnyvale, Calif.) scanning laser densitometer using an ImageQuant software package (Molecular Dynamics). Using this software, a 96-well grid was placed on the image of the autoradiograph and the densitometer calculated the "volume" of each dot ("volume" is equivalent to the density of each pixel in the grid square multiplied by the area of the grid square). The program automatically subtracts background. The background was determined by either the background of a line or object drawn outside the grid or by using the gridlines as background for each individual dot.

The data is exported to a spreadsheet program, such as "EXCEL" (Microsoft Corporation, Redmond, Wash.) for further analysis.

D. Analysis of Data.

The data generate from the densitometry analysis was analyzed using the spreadsheet program "EXCEL."

For each test oligonucleotide, at each drug concentration and/or each time point, a raw % score was calculated. The raw % score (r %) can be described as r %=(T/C)×100 where T was the densitometry volume of the test sample and C was the densitometry volume of the control sample. The oligonucleotides were then ranked from 1 to 256 based on their r % score. Further calculations were based on the rank of each oligonucleotide with respect to all other oligonucleotides.

The rank of each oligonucleotide was averaged over several experiments (where one experiment is equivalent to testing all 256 test oligonucleotides by the assay of the present: invention) in view of the variability in rank between any two experiments. The confidence level for the ranking of the oligonucleotides increased with repetition of the experiment.

FIG. 15 shows the results of 4 separate experiments with distamycin. The test samples were treated with 10 µM distamycin for 30 minutes. The r % scores are shown for each of the 4 experiments (labeled 918A, 918B, 1022A, and 1022B) and the ranks of each oligonucleotide in each experiment are shown. The test oligonucleotides have been ranked from 1 to 256 based on their average rank. The average rank was the sum of the ranks in the individual experiments divided by the number of experiments.

FIGS. 16 and 17 show the results presented in FIG. 15 in graphic form. FIG. 16 shows the average ranks plotted against the ideal ranks 1 to 256. FIG. 17 shows the average r % scores plotted against the rank of 1 to 256. These data demonstrate the reproducible ability of the assay to detect differential binding and effects of distamycin on different 4 bp sequences.

EXAMPLE 11

Determining a Consensus Binding Site for Distamycin

One method used to determine the sequence preferences for distamycin was to examine the sequences that rank highest in the assay for sequence similarities. This process may be accomplished visually or by designing computer programs to inspect the data.

Using the data shown in FIG. 15, consensus sequences can be constructed for distamycin in the following manner. Sequences with rankings less than 50 (indicating a strong effect of distamycin on the test sequence) in all four experiments were:

TABLE VI

| Sequence | Rank |
| --- | --- |
| TTCC | 1 |
| TTAC | 2 |
| TACC | 3 |
| TATC | 4 |
| TTCG | 6 |
| ACGG | 8 |

Sequences with rankings less than 50 (indicating a strong effect of distamycin on the test sequence) in three of the four experiments were:

TABLE VII

| Sequence | Rank |
| --- | --- |
| AACG | 5 |
| TTTC | 7 |
| TTAG | 10 |
| TAAC | 12 |
| TACG | 15 |
| AGAC | 17 |

TABLE VII-continued

| Sequence | Rank |
|---|---|
| AAAC | 18 |
| AGCG | 21 |
| AGCC | 22 |
| TTCT | 24 |
| ACGC | 25 |
| AGGG | 28 |
| AGGC | 30 |
| TTGC | 37 |
| ATCG | 39 |
| TTTG | 43 |

Sequences with rankings less than 50 (indicating a strong effect of distamycin on the test sequence) in two of the four experiments were:

TABLE VIII

| Sequence | Rank |
|---|---|
| TAGC | 9 |
| TTGG | 11 |
| AAAG | 13 |
| AACC | 14 |
| CAAC | 16 |
| ATCC | 19 |
| AAGG | 20 |
| TAAG | 23 |
| ACCC | 26 |
| TCCC | 29 |
| TATG | 31 |
| ACCG | 32 |
| TCGG | 34 |
| AGTC | 35 |
| CTCG | 38 |
| AATC | 44 |
| AGAG | 46 |
| TTAA | 47 |
| ACAC | 48 |
| AGTG | 49 |
| TCAC | 52 |

The following assumptions allow prediction of a consensus sequence for a distamycin recognition sequence: (i) the most favored sequences are the test sequences that rank in the top 50 in all four experiments; (ii) the next favored sequences will be the test sequences that rank in the top 50 in 3 of 4 experiments; and (iii) the next favored sequences will be the test sequences that rank in the top 50 in 2 of 4 experiments.

The positions in the test sequence are represented by the numerals 1, 2, 3 and 4. One consensus sequence that predicted from the above binding data is:

| 1 | 2 | 3 | 4 |
|---|---|---|---|
| T | T/A | N | C/G |

The nucleotides at each position can also be ranked:

| 1 | 2 | 3 | 4 |
|---|---|---|---|
| T | T > A | C > A > T > G | C > G |

Furthermore, the importance of the position of the nucleotide can be ranked. Examination of this data would indicate that the importance of the positions is

1>4>2>3.

These data can be tested for validity by deriving all possible consensus sequences and examining their scores in the assay. The consensus sequences derived from the above information, in order of rank as predicted by the consensus sequence, are:

TABLE IX

| Sequence | Predicted Rank | Actual Rank |
|---|---|---|
| TTCC | 1 | 1 |
| TACC | 2 | 3 |
| TTCG | 3 | 6 |
| TACG | 4 | 15 |
| TTAC | 5 | 2 |
| TAAC | 6 | 12 |
| TTAG | 7 | 10 |
| TAAG | 8 | 23 |
| TTTC | 9 | 7 |
| TATC | 10 | 4 |
| TTTG | 11 | 43 |
| TATG | 12 | 31 |
| TTGC | 13 | 37 |
| TAGC | 14 | 9 |
| TTGG | 15 | 11 |
| TAGG | 16 | 58 |
| Averagerank: | | 17 |

Note that the actual rank numbers are out of a possible 256 and that only one number is greater than 50. The average rank of these 16 oligos is only 17. These data indicate that the consensus sequence has predictive value.

Using the same data, a second consensus sequence can be derived that has slightly worse average rank with respect to the relative effect of distamycin in the assay.

TABLE X

| 1 | 2 | 3 | 4 |
|---|---|---|---|
| A | A/G/C | G/C/A | G/C |
|   | A>G=C | C>A=G | G=C |

The test sequences predicted by this consensus sequence are as follows:

TABLE XI

| Sequence | Actual rank |
|---|---|
| AACG | 5 |
| AACC | 14 |
| AAAG | 13 |
| AAAC | 18 |
| AAGG | 20 |
| AAGC | 74 |
| AGCG | 21 |
| AGCC | 22 |
| AGAG | 46 |
| AGAC | 17 |
| AGGG | 28 |
| AGGC | 30 |
| ACCG | 32 |
| ACCC | 26 |
| ACAG | 73 |
| ACAC | 48 |
| ACGG | 8 |
| ACGC | 25 |
| Ave. rank: | 29 |

This consensus sequence also appears to be predictive of favored distamycin binding sit:es since the average rank of test oligonucleotides predicted by this sequence is 29, substantially below the median rank of 128. However, the sequences predicted by this consensus sequence do not appear to be affected as strongly by distamycin as the sequences in the first consensus sequence, described above.

EXAMPLE 12

Testing Actinomycin D to Determine Sequence Specificity and Relative Binding Affinity A. Ranking of Actinomycin D Sequence Binding Affinities.

Actinomycin D has been tested for sequence selectivity and relative binding affinity to the 256 different 4 bp sequences. The assay was performed essentially as described in Example 10. One assay mixture useful for the testing of actinomycin 1) contained 1.5 nM radiolabeled DNA and 12.8 nM UL9-COOH protein prepared as described above in the UL9 binding buffer (20 mM Hepes, pH 7.2, 50 mM KCl, and 1 mM dithiothreitol). The concentration of the components can be varied as described in the Detailed Description. The assay mixtures containing both UL9 and DNA were incubated at room temperature for at least 10 minutes to allow the DNA:protein complexes to form and for the system to come to equilibrium. At time=0, the assay was begun by adding water (control samples) or actinomycin D (25 µM, test samples) to the assay mixtures using a 12-channel micropipettor. After incubation with drug for 30 minutes, samples were taken and applied to nitrocellulose filters using a 96-well dot blot apparatus (Schleicher and Schuell) held at 4° C. FIG. 18 shows the results of 8 screens of actinomycin D.

The % reduction in DNA:protein complex as a result of the presence of actinomycin D is called "r %"; the lower the r % score, the more effective the test molecule in blocking the DNA:protein interaction. For each screen, the test oligonucleotides have been ranked from 1 to 256, based on the r % score; the rank of 1 denotes the lowest r % score (the test oligonucleotide most effected by the test molecule), the rank of 256 denotes the highest r % score (the test oligonucleotide least effected by the test molecule). The table also shows the average r % score and average rank of each test oligonucleotide; the averages are calculated from the sum of the individual scores and ranks divided by the number of screens, respectively. The test oligonucleotides are then ranked from 1 to 256 based on the average rank in all screens. The final ranking is shown in the two external columns on the table. Test oligonucleotides ranking less than 50 in any individual screen are shown in highlighted boxes.

Figure 19:
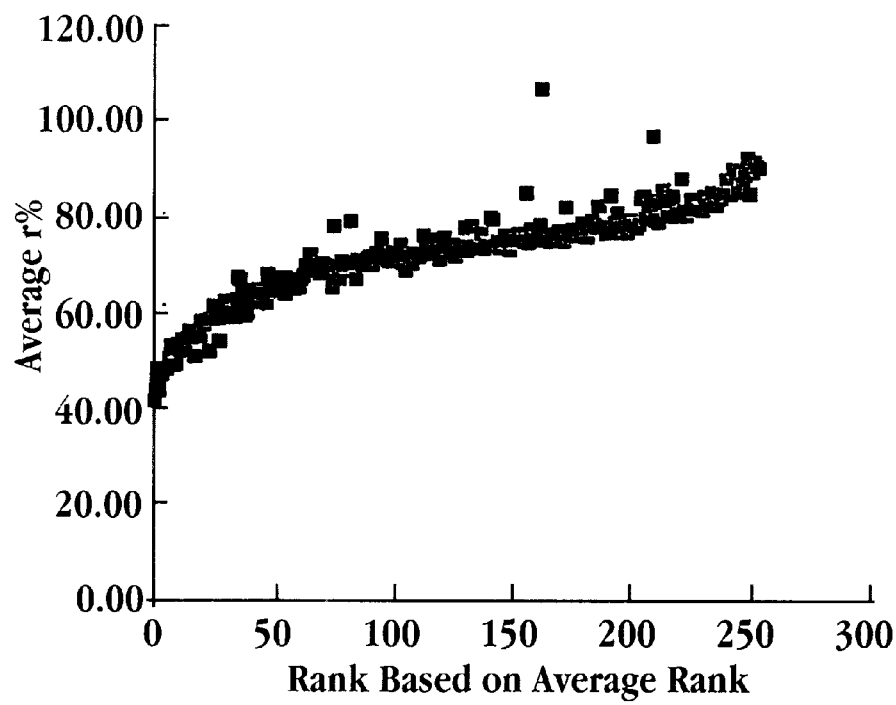
FIG. 19 shows the average r % versus rank, by average rank (data from FIG. 18).

FIG. 19 shows the final rank of test oligonucleotides screened with actinomycin D plotted against the average r % score for these test oligonucleotides.

Figure 20:
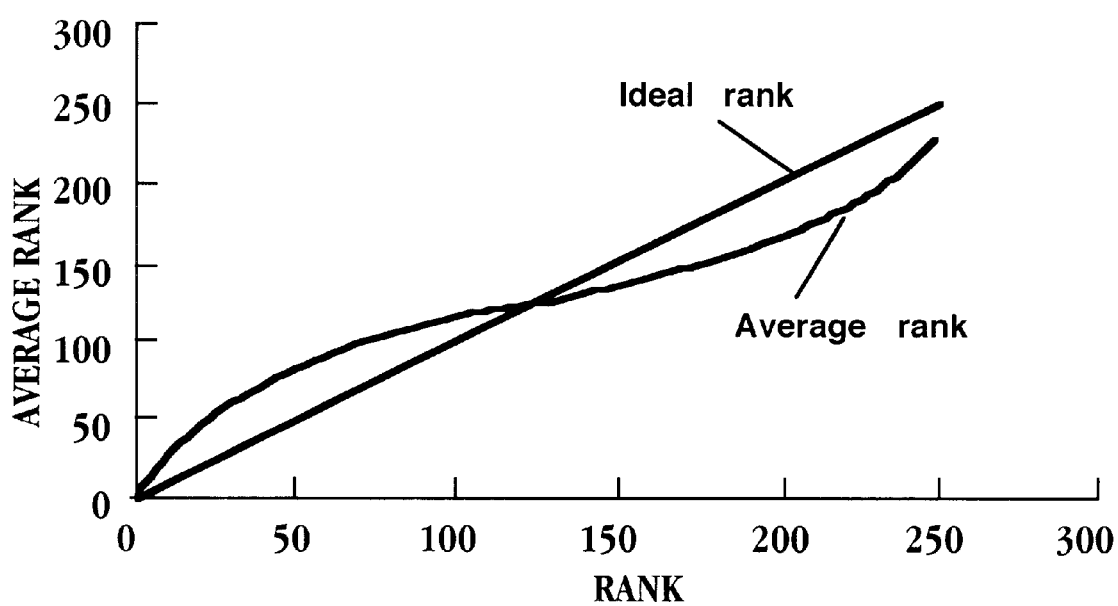
FIG. 20 shows the ideal and average ranks for each of the 256 oligonucleotides.

FIG. 20 shows the final ranking vs. the ranks in each individual experiment, the average rank, and the ideal rank.
B. Analysis of the Data Obtained from Ranking Actinomycin D Sequence Binding Affinities.

Several simple analytical procedures may be applied to the data from the screens.

1. Position Effects.

First, to examine possible preferences of the test molecule for a base at any particular position in the test site, the average r % scores are examined. The average r % scores for each of the 64 possible test oligonucleotides at each position in the test site are averaged. For example, to determine the effect of having an A in the first position of the test site, the "$A_1$" position, the average r % scores for the 64 test oligonucleotides with A in the first position are averaged. The results of this analysis are shown in FIG. 21. The mean score for all oligonucleotides in these screens was r % value 67; the standard deviation was 11.8.

If the r % score is expressed as variance from the mean, as shown in FIG. 21, one observes that none of the scores is markedly deviant from the mean. These results suggest that a single base in any particular position has little impact on the binding of the actinomycin D to the test site.

2. Dinucleotide Analysis.

The results of the actinomycin D screen were examined for the presence of dinucleotide pairs that scored well or poorly in the rankings. High scores indicate a preference for the test sequence. Low scores indicate a repulsion of actinomycin D for the test sequence. A dinucleotide analysis is one of many simple analytical procedures that may be applied to the data to extract meaningful impressions about the nature of the sequences to which the test molecule has high affinity.

The data are examined in a manner similar to that used for the single nucleotide analysis. The 16 possible average r % scores for any particular dinucleotide combination are examined. Specific adjacent dinucleotides ($N_1N_2$, $N_2N_3$, $N_3N_4$) or adjacent dinucleotide pairs at any particular position ($N_xN_{x+1}$=the average of $N_1N_2$, $N_2N_3$, and $N_3N_4$) may be examined, as well as specific dinucleotide pairs that are not adjacent ($N_1N_3$, $N_2N_3$, $N_1N_4$) and any dinucleotide pair separated by one base ($N_xN_{x+2}$=the average of $N_1N_3$ and $N_2N_3$). The means for each set are determined as well as standard deviations.

The difference from the mean (i.e., the mean score less the average r % score for any particular dinucleotide) reflects the extent of deviation from the norm. Differences from the mean greater than 2–3 standard deviations from the mean are considered to be significant. The data for the dinucleotide analysis of actinomycin D is shown in FIG. 22. The differences from the mean are displayed graphically in FIG. 23.

Figure 23:
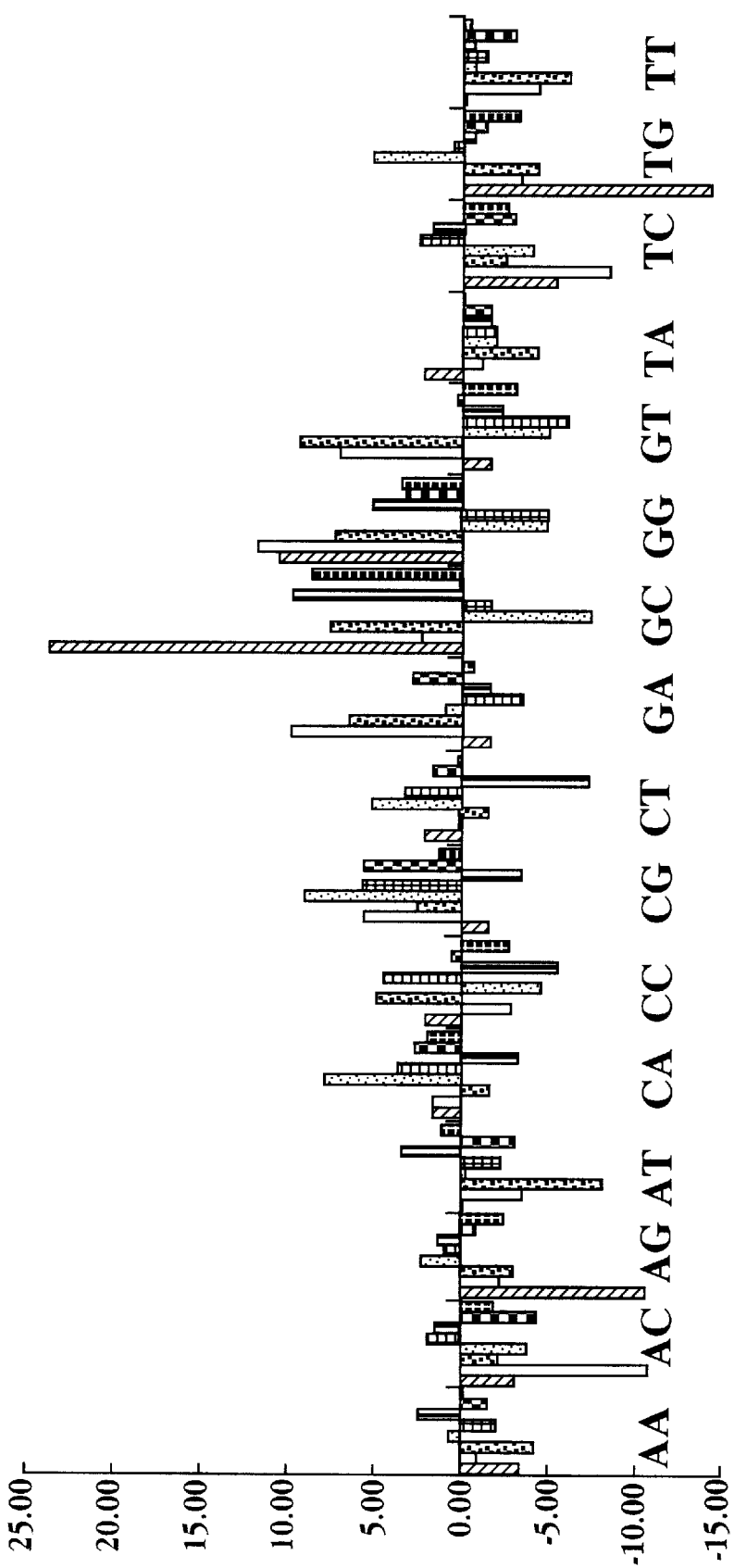
FIG. 23 graphically displays the results presented in FIG. 22.

In reference to FIGS. 22 and 23, the dinucleotide preference of actinomycin D is GC, particularly in the $N_1N_2$ position, but also at any ($N_xN_{x+1}$) adjacent dinucleotide sequence in the test site.

Figure 24:
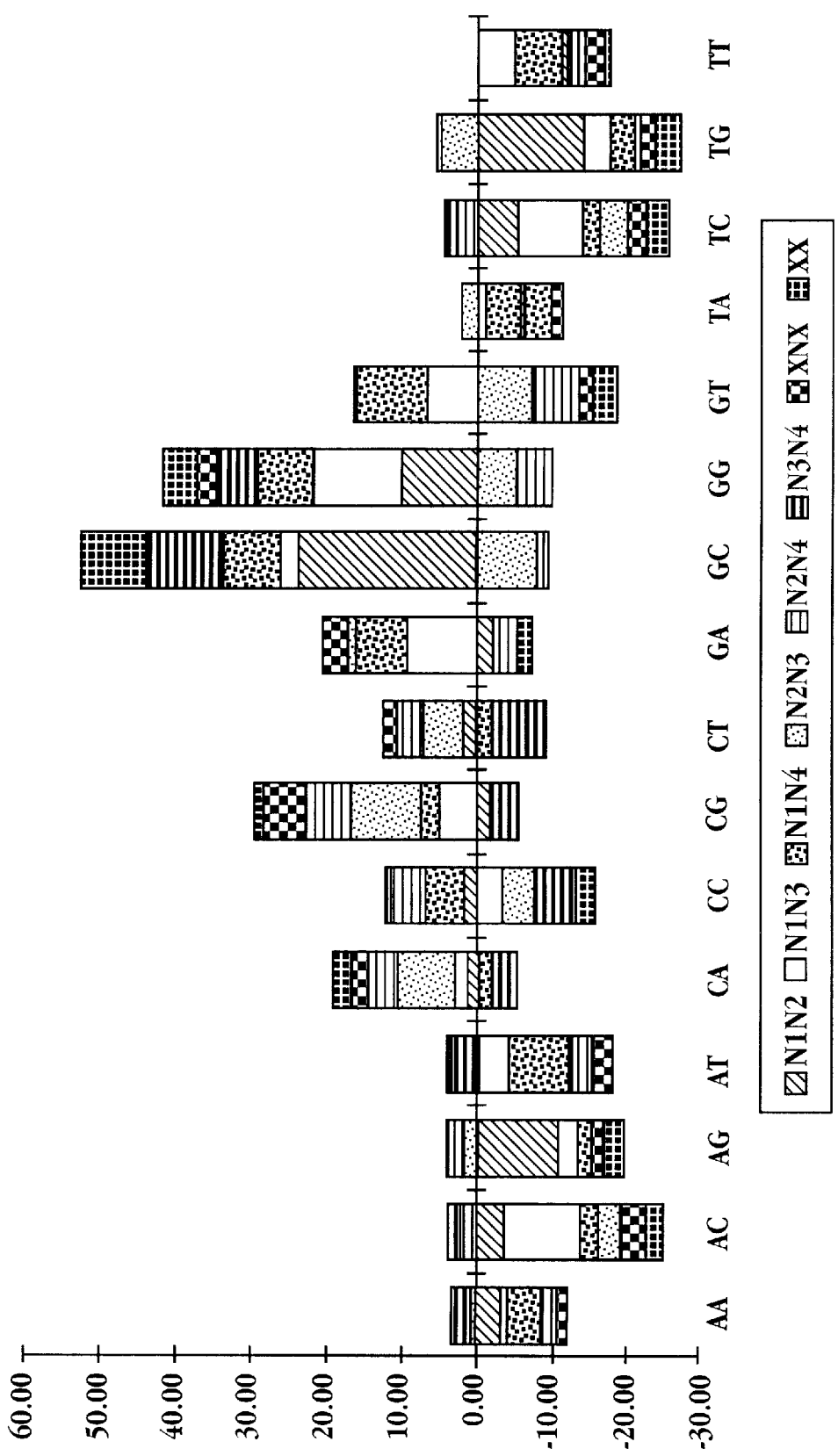
FIG. 24 graphically displays the data presented in FIG. 22, where the data are combined in a combined bar chart so that the cumulative results for any dinucleotide pair are tabulated in a single bar.

If the data are combined in a combined bar chart, shown in FIG. 24, where the cumulative results for any dinucleotide pair are tabulated in a single bar, the overall observation can be made that actinomycin D prefers GC-rich sequences over AT-rich sequences, with a particular preference for the dinucleotide pairs involving GC.

EXAMPLE 13

A Method for Selecting Target Sites for DNA-Binding Molecules that are Dimers or Trimers of Distamycin Once the relative binding preferences of a distamycin have been determined, sequences are selected for target sites for DNA-binding molecules composed of two distamycin molecules, bis-distamycins, or three distamycin molecules, tris-distamycins.
A. Selecting Sequences for Binding with Highest Affinity to Distamycin Oligomers.

The top binding sites for distamycin, determined as described above, are defined by the consensus sequence, 5'-T:T/A:C/A:C-3': accordingly, the top sequences are TTCC, TTAC, TACC and TAAC. Using this information, $2^4$=16 possible dimer sequences, i.e., combinations of the four top binding sequences, can be targeted by a bis-distamycin in which the distamycin molecules are immediately adjacent to one another.

The top strands of the 16 possible duplex DNA target sites for binding bis-distamycins are shown in FIG. 25. Similarly, trimers of distamycin, tris-distamycins, could be targeted toward selected 12 bp sequences, comprised of all possible combinations of the four 4 bp sequences. There are $3^4$=81 possible highest affinity target trimer sequences.

There are several advantages to targeting longer sequences with bis- or tris-distamycin:
B. As the Number of Potential Target Sites Decreases, Specificity Increases.

All 8 bp combinat:orial possibilities of the 4 top favored binding sites for distamycin are potential high affinity binding sites for bis-distamycin. The consensus sequence used in this example predicts four favored binding sites for distamycin. This represents $(4/4^4)*100$=about 1.6% of the possible 4 bp sites in the genome. Since there are $4^8$ possible 8 bp sequences, this represents, on average, only $(2^4/4^8)*100$= about 0.02% of the total genome. There are $4^{12}$ possible 12 bp sequences, this represents, on average, only $(3^4/4^{12})$ *100=0.00000075% of the genome.

The following discussion provides perspective and illustrates the improvement in the actual number of target sites in the human genome for when using a dimer of distamycin versus a monomer of distamycin. The human genome is about $3 \times 10^9$ bp. If the number of favored target sites for distamycin is four, and the number of possible 4 bp sequences is $4^4$=256, then the number of favored target sites in the genome is $(4/256)$ $(3 \times 10^9)=4.7 \times 10^7$, or about 50 million favored target sites.

Given that the number of possible 8 bp sites is $4^8$=65,536, if all possible combinatorial 8 bp sites derived from the favored 4 bp sites ($2^4$=16; FIG. 25) are favored, then the number of favored 8 bp target sites is $(16/65,536)$ $(3 \times 10^9)$= $7.3 \times 10^5$ or about 700,000 possible sites. This represents a 64-fold reduction in the number of highest affinity target sites between distamycin and bis-distamycin; alternatively, this result can be viewed as a 64-fold increase in specificity.

Likewise, given that the number of possible 12 bp sites is $4^{12}=1.7 \times 10^7$, if all possible favored 12 bp sites ($3^4$=81) are favored, then the number of favored 12 bp target sites is $(81/1.7 \times 10^7)$ $(3 \times 10^9)=1.4 \times 10^4$: i.e., 14,000 possible highest affinity sites. This represents an approximately 3000-fold decrease in the number of highest affinity target sites between distamycin and tris-distamycin and a 500-fold decrease in the number of highest affinity target sites between bis-distamycin and tris-distamycin.

C. An Exponential Increase in Affinity.

As the target site increases in size, (i) the number of target sites in a defined number of nucleotides decreases, and (ii) the specificity increases. Further, the affinity of binding is typically the product of the binding affinities of component parts (see Section VI.E.1 above). As an example, the published binding constant for distamycin to bulk genomic DNA is about $2 \times 10^5$ M$^{-1}$. Dimers of distamycin will have a theoretical binding affinity of the square of the binding constant of distamycin:

$$(K_{dista,average}=2 \times 10^5 M^{-1}; K_{bis-dista}=(2 \times 10^5 M^{-1})^2=4 \times 10^{10} M^{-1}).$$

Trimers of distamycin will have binding affinities of the cube of the binding affinity of distamycin:

$$(K_{tris-dista}=(2 \times 10^5 M^{-1})^3=8 \times 10^{15} M^{-1}).$$

Thus, if distamycin shows only a 10-fold higher affinity ($2 \times 10^6 M^{-1}$) for the top favored binding sites than the average binding sites in DNA, then the affinity constant for bis-distamycin to an 8 bp site comprised of two favored binding sites is 100-fold higher than for an 8 bp sequence comprised of two average binding sites:

$$(K_{bis-dista, favored\ sites}/K_{bis-dista, average\ sites}=(2 \times 10^6)^2/(2 \times 10^5)^2=100).$$

While this does not represent absolute sequence specificity in binding, the binding affinity is 100-fold greater for 0.02% (16/65,536) of the total possible 8 bp target sequences.

The use of a trimer targeted sequence will afford an even higher increase in affinity to the most favored binding sites:

$$K_{tris-dista, favored\ sites}/K_{tris-dista, average\ sites}=(2 \times 10^6)^3/(2 \times 10^5)^3=1000.$$

Thus, with only 10-fold differential activity in binding between favored sites and average sites, a 1000-fold difference in affinity can be achieved by designing trimer molecules to specific target sites. When considering the administration of DNA-binding molecules as drugs, a 1000-fold lower dose of tris-distamycin, versus the distamycin monomer, could be administered and an increase in relatively specific binding to selected target sites achieved.

In this example, the differential activity of distamycin is only 10-fold. Clearly, differential activities of larger magnitudes will greatly accentuate the increased affinity effect. For example, a 100-fold difference in activity of a 4 bp DNA-binding molecule toward high affinity and average affinity sequences would result in (i) a 10,000-fold difference in the binding affinity of a dimer of the molecule targeted to an 8 bp sequence, and (ii) a million-fold increase in the binding affinity of the trimer to a 12 bp sequence.

D. Selecting Target Sequences for Distamycin Oligomers with Flexible and/or Variable-Length Linkers in Between the Distamycin Moieties.

The sequences that: can be targeted with bis- or tris-distamycin molecules are not limited to sequences in which the two 4 bp favored binding sites are immediately adjacent to one another. Flexible linkers can be placed between the distamycin moieties and sequences can be targeted that are not immediately adjacent. The target sequences can have distances of 1 to several bases between them: this distance depends on the length of the chemical linker. Examples of bis-distamycin target sequences for bis-distamycins with internal flexible and/or variable length linkers targeted to sites comprised of two TTCC sequences are shown in FIG. 26, where N is any base.

For each particular bis-distamycin, the explanations of increased affinity and specificity remain the same as described above with the following exception. For the case in which the linker was sufficiently flexible to span different numbers of bases in between the two distamycin sites, the number of sites targeted with highest affinity would be multiplied by the number of bases spanned.

In respect to the ease of drug design and target selection, there are several advantages to the above described targeting strategies, including the following:

i) Any conformational changes induced by binding at the half-site would be minimized.

ii) The affinity, therefore, would be more likely to be the product of the affinities of the interactions observed for the monomeric sites.

iii) The half-molecule (e.g, 1 distamycin unit) would anchor the bis-molecule (e.g., bis-distamycin) thus increasing the localized concentration for the binding of the second half of the bis-molecule.

iv) If a simple linking chain is used, with a variable number of atoms, the number of sites that: can be targeted by multimers of the monomer increases. This targeting method can be of value when, for example, there are no medically significant target sites with adjacent favored binding sites for distamycin. Therefore there are no good target sites for bis-distamycin. In this situation, the database can be screened for additional target sequences with $N_1$ to n (where N is any base) between the two target binding sequences. For example, where n=4, the number of sequences to be searched becomes $(4^2)*4=64$. The likelihood of finding such a sequence is reasonably high.

E. Selecting a Specific Target Site.

Using the above approach, a sequence was identified from the medically significant target site database that contains SEQ ID NO:619, which is a subset of the group of sequences represented by SEQ ID NO:620. SEQ ID NO:619 occurs overlapping the binding site for a transcription factor, Nuclear Factor of Activated T Cells (NFAT-1), which is a major regulatory factor in the induction of interleukin 2 expression early in the T cell activation response. NFAT-1 is crucial in (i) the T cell response, and (ii) in blocking the expression of IL-2, which causes immunosuppression. The sequences TTCC and TTTC, the distamycin target binding sequences in SEQ ID NO:619, rank first and seventh in the assay.

EXAMPLE 14

The Use of the Assay in Competition Studies

The assay of the present invention measures the effect of the binding of a DNA-binding molecule to a test site by the release of a protein from an adjacent screening site. Accordingly, the assay is an indirect assay. Following here is the description of an application of the assay useful to provide confirmatory evidence of the data obtained in the initial screening processes.

The results of the distamycin screening assay described in Example 10 suggested that there were possible false negatives: specifically, test sequences that bind distamycin but fail to show an effect on the binding of the reporter protein. The data suggesting false negatives was as follows. If the assay detected strictly the affinity of binding of distamycin, then the scores of the test sequences complementary to the high-scoring test sequences should always be equally high. However, an examination of the highest ranking test sequences and the complementary test sequences reveals that this is not the case (see Table XII).

TABLE XII

| Rank | Test Sequence | Complement | Rank of complement |
|---|---|---|---|
| 1 | TTCC | GGAA | 42 |
| 2 | TTAC | GTAA | 244 |
| 3 | TACC | GGTA | 185 |
| 4 | TATC | GATA | 213 |
| 5 | AACG | CGTT | 144 |
| 6 | TTCG | CGAA | 216 |
| 7 | TTTC | GAAA | 235 |

All but one of the complementary sequences rank in the lower half, 4 of them in the lowest 20%, i.e., these was little effect on reporter protein binding in the presence of distamycin when using these sequences as test sequences in the assay.

This observation reflects the usefulness of a confirmatory assay that examines the relative affinity of a particular sequence for binding distamycin. A confirmatory assay may also be useful in revealing additional information about the physical characteristics of drug binding. For example, one can hypothesize that the reason for the apparent inverse relationship between test sequences with high activity in the assay and their complements is that the effect of distamycin is directional and only active at one test site. This hypothesis can be tested using the following competition experiment. Competitor oligonucleotides, containing test sequences of interest, are added to the assay mixture. This allows the determination of which test sequences compete most effectively with the radiolabeled test oligonucleotide for binding distamycin.

Assay mixtures are prepared as described in Example 10, using a high-ranking test oligonucleotide, e.g., TTCC (ranking=#1), as the radiolabelled oligonucleotide in the experiment. The test oligonucleotide TTCC is labelled to high specific activity with $\gamma$-$^{32}$P-ATP as described in Example 8: in this example, the labeled TTCC oligonucleotide will be referred to as the "high specific activity test oligonucleotide".

The competitor oligonucleotides are labeled as described in Example 8, except that the ATP used for kinasing the primer is 1:200 radiolabeled:nonradiolabeled. In other words, the competitor oligonucleotides are tracer labeled with radioactive phosphorous to a 200-fold lower specific activity than the high specific activity test oligonucleotide. Since all of the competitor oligonucleotides are labeled with the same radiolabeled primer molecule, the relative concentrations of the competitor DNAs can be determined with high accuracy. Further, since the specific activity is the same, the concentrations can be adjusted to be the same. For the purposes of this example, the competitor DNAs are referred to as "low specific activity competitor oligonucleotides."

The use of competitor DNAs for which the concentration is known is important for the competition experiment. The accuracy of the competition assay may be further enhanced by separating any unincorporated radiolabeled primer from the double stranded competitor oligonucleotides. This separation can be achieved using, for example, a 6–20% polyacrylamide gel. The gel is then exposed to x-ray film and the amount of double-stranded oligonucleotide determined by use of a scanning laser densitometer, essentially as described in the Examples above.

The competition assay is performed as described in Example 10, except that competitor DNAs are added in increasing relative concentration to the high specific activity test oligonucleotide. The DNA concentration ([DNA]) is held constant and the UL9 concentration ([UL9]) and distamycin concentration ([distamycin]) are as described in Example 10. The components in the competition assay samples are as follows.

Controls:

UL9+TTCC*; UL9+TTCC*+Competitors; UL9+TTCC*+distamycin;

Test samples:

UL9+TTCC*+distamycin+Competitors;

where UL9 is UL9-COOH, TTCC* is the high specific activity test oligonucleotide, and Competitors are the low specific activity competitor oligonucleotides.

TTCC-low (the tracer-labeled low specific activity competitor) competes with TTCC* on an equimolar basis for the binding of both protein and distamycin. A competitor molecule with lower affinity for distamycin than TTCC requires a higher molar ratio to TTCC* to compete for distamycin binding. The competition for protein between all competitors is constant. Only the competition for distamycin varies; the variability is due to the differential affinity of the competitor oligonucleotides for distamycin. The concentration of competitor used in these experiments varies over a range of concentrations and is determined empirically by (a) the test molecule concentration, and (b) the relative affinity of the competitor and the radiolabeled test oligonucleotide. Typically, the competitor DNA consists of only the test sequence, that is, no additional sequences are connected to the test sequence.

The competition assay described here facilitates the determination of actual rank between the test oligonucleotides that are detected as highly effective molecules in the original assay. The competition assay also facilitates the detection of false negatives. As described above, the results of the assay discussed in Example 10 imply "directional" binding of distamycin, in which the effect of binding is only detected when the molecule is bound in one direction with respect to the UL9 protein. Binding in the opposite direction (i.e., to the complementary test sequence) is not detected with the same activity in the assay.

The purpose of this competition experiment is to use the test oligonucleotides to compete for the binding of distamycin. If the sequences complementary to the "best binders" are false negatives in the assay, they should nonetheless be effective competitors in the competition assay.

EXAMPLE 15

A Method of Selecting Target Sequences from Database Sequence Information

The binding of a drug or other DNA-binding molecule to the recognition sequence for TFIID, or other selected transcription factors, is expected to alter the transcriptional activity of the associated gene. TATA-boxes, which are the recognition sequences for the transcriptional regulatory factor TFIID, are associated with most eukaryotic promoters and are critical for the expression of most eukaryotic genes. Targeting a DNA-binding drug to TATA boxes in general would be undesirable. However, sequences flanking TATA box sequences are typically unique between genes. By targeting such flanking sequences, perhaps with one base overlapping the TFIID recognition site, each gene can be targeted with specificity using the novel DNA-binding molecules designed from the data generated from the DNA-binding drug assay. One method for determining novel and specific target sequences for novel DNA-binding drugs is described here. The method may be applied to any known binding site for any specific transcription factor, regardless of whether the identity of the transcription factor itself is known.

TATA-boxes have been determined for a large number of genes. Typically, the TATA-box consensus sequence has been identified by examining the DNA sequence 5' of the RNA start site of a selected gene. However, the most rigorous determinations of TATA boxes have also demonstrated the transcription factor binding site by DNA protection experiments and DNA:protein binding assays (using electrophoretic methods). Many of these sites are annotated in the public databases "EMBL" and "GENBANK", which both contain sequences of nucleic acids sequences. Unfortunately, the flat field listing of these databases do not consistently annotate these sites. It is possible, however, to automatically search a database, using a text parsing language called AWK, to extract most sequence information that relates to annotated promoter sequences.

The following is a description of how selected promoter sites were located in the public database from "EMBL." The flat field annotations from "EMBL" Version 32 as processed by "INTELLIGENTICS" (Mountain View, Calif.), were obtained with the set of UNIX programs call "IG-SUITE." These programs were executed on a "SUN IPX" workstation. An AWK script was used to parse all the primate annotation files listed in the "EMBL" database. The AWK interpreter is supplied as part of the system software that comes with the "SUN IPX" workstation.

The following is a description of how the AWK parses annotation files looking for and printing information relating to promoters and TATA-boxes. The system is asked to examine the input files for certain key words in the header lines or annotations to the sequence. The AWK interpreter reads input files line by line and executes functions based on patterns found in each line. In this case, the AWK system read the annotation files of EMBL. The following is a description of how the AWK script can be used to parse out sequences containing TATA-boxes.

The program first examines the files for all header lines containing the word "complete" but not "mRNA" or "pseudogene"; the output is printed. Complete genes sometimes contain the promoter sequences but complete mRNA genes do not contain the promoters. mRNA genes are not of interest for the purpose of detecting promoter elements. Next, the AWK system looks for the word "exon 1" and if it finds it prints the header and "DE" line. Then it looks for "5'" and prints the header line if it does not contain the word "mRNA". Next it looks for the word "transcription" and if it finds it prints the preceding and following line along with description line.

Next, the AWK system examines the files for the word "TATA" in the header lines or references. This results is printed. After this it looks for the word "promoter" and if it finds it prints that line and the line after it which contains the information about the promoter. Then the program looks for "protein_bind" and prints that line along with the next one. The description of "protein_bind" is usually used to mark potential binding sites of transcription factors in the "EMBL" database. AWK then scans for any annotated primary mRNA start sites. The promoter sequence is found in front of the start site. Finally, any exon 1 start sites that are annotated in the feature table are extracted. Exon 1 start sites should also be the primary transcription start site and the TATA boxes usually are found approximately 25–35 base pairs 5' to the transcriptional start site.

The actual AWK script is included here as an example of how to parse a database to extract promoter sites:

```
BEGIN {print_next_line==0}
{if (print_next_line==1)
    {print $0
    print_next_line=0}
}
{if ($0 ~/^>/)
    { Locus=$0
     1_flag=0 }
}
/^>/ && / [Cc]omplete/ && $0 !~
/mRNA|mrna/ && $0 !~/pseudogene/{print}
/^>/ && /exon 1[^0-9]/ {print}
/^>/ && /5'/ && $0 !~ /mRNA|mrna/ {print}
/[Tt]ranscription/ {print Locus "\n" PL "\n" $0;print_next_line=1}
{if ($0 ~/^FT/ && $0 ~/TATA/ && $0 ~/note/)
    {print Locus "\n" PL"\n"$0}
}
{if ($0 ~/^FT/ && $0 ~/[Tt]ranscription/ && $0 ~/\//)
    {print Locus "\n" PL"\n"$0}
}
{if($2 !~ /note/ && $2 ~/TATA/) {print Locus "\n" $0} }
{if ($2 ~/promoter/)
    {print_next_line=1
    if(1_flag==0)
      {print Locus "\n" $0
      1_flag=1}
    else
      print $0
    }
}
{if ($2 ~/protein bind/)
    {print Locus "\n" $0
    print_next_line=1}
}
{if ($2 ~/prim_transcript/ && $3 !~/^1 .. |^<1 .. /}
```

-continued

```
    {print_Locus "\n" $0
     print_next_line=1}
}
{if ($0 ~/^FT/ && $0 ~/number=1[^0-9]/)
    if(PL ~/exon/){print Locus "\n" PL"\n"$0}
}
{PL=$0}
```

After the AWK script is run on the database the output is manually examined. Those sites that are clearly promoter sites are noted and nucleotide coordinates recorded. Other gene sequences are examined using the "FINDSEQ" program of "IG_SUITE" to see if the promoter sites can be determined or if the references in the database describe the promoter sequences. If so, those nucleotide coordinates are noted. At the end of this examination "FINDSEQ" is used to extract any sequences containing promoter sequences by using an indirect file of "LOCUS" names constructed using a text editor.

A parsing program was also written to extract each of the annotated sites from the file that "FINDSEQ" extracted from "EMBL." This program extracts the following information: the promoter site name and four numbers representing the nucleotide coordinates of where the sequence is to start, what the coordinate of the first base of the site is, the coordinate of the last base of the site and the end of the sequence to be extracted. A large batch file was constructed to automatically extract each of the promoter sites. These sequences formed the basis of Table V.

The Sequence Listing presents a number of sequences that are useful as test sequences in the present invention. SEQ ID NO:1 to SEQ ID NO:481 and SEQ ID NO:600 correspond to promoter targets (typically, TATA box-containing sites) for human genes. SEQ ID NO:482 to SEQ ID NO:599 correspond to promoter targets for viral genes.

EXAMPLE 16

Using Normalized Values to Determine Sequence Specificity and Relative Binding Affinity A. The Assay Mixture and Calibrator Samples.

The assay mixture is prepared as described in Example 10. The concentration of the components can be varied as described in the Detailed Description.

The assay mixtures containing both UL9 and DNA are incubated at room temperature for at least 10 minutes to allow the DNA:protein complexes to form and for the system to come to equilibrium. At time=0, the assay is begun by adding water (control samples) or test molecule (typically at 1–5 $\mu$M, test samples) to the assay mixtures using a 12-channel micropipettor. After incubation with drug for 5–120 minutes, samples are taken and applied to nitrocellulose filters using a 96-well dot blot apparatus (Schleicher and Schuell) held at 4° C.

Calibrator samples are used to normalize the results between plates, that is, to take plate-to-plate variability into account. Calibrator samples are prepared using 2-fold serial dilutions of DNA in the assay mixture and incubating duplicate samples in one column of the 96-well assay plate. The highest concentration of DNA used is the same concentration used in the screening samples. In general, calibrator samples are used in all experiments. However, use of calibrator samples appears to be less important for experiments using blocked plates since the variability between blocked plates is lower than between unblocked plates.

The calibrator samples are used to normalize the values between plates as follows. The volume values (Example 10) for the calibrator samples are obtained from densitometry. Volume values are plotted against DNA concentration. The plots are examined to ensure linearity. The volume values for the points on the calibrator line are then averaged for each plate. A factor, designated the normalization factor, is then determined for each calibrator line. When the normalization factor is multiplied by the average of the points on each calibrator line, the product is the same number for all plates. Usually, the average of the line averages is used for determining the normalization factor, although in theory, any of the line average numbers can be used. The operating assumption in this analysis is that the differences in the calibrator samples reflected the differences in adsorption for each plate. By normalizing to the calibrator samples, these variations are minimized.

Once the normalizing factor is obtained, all of the raw volume values for each of the test assays on the plate is multiplied by the normalizing factor. For example, if the following data were obtained, the process of normalization would be as follows:

TABLE XIII

| PLATE NUMBER | DNA CONCENTRATION | | | | |
|---|---|---|---|---|---|
| | 0.8 | 0.4 | 0.2 | 0.1 | Average |
| Plate I: | 4000 | 2000 | 1000 | 500 | 1875 |
| Plate II: | 4200 | 2100 | 1050 | 525 | 1969 |
| Plate III: | 3800 | 1900 | 950 | 475 | 1781 |
| | | | Average: 1875 | | |

Plate I has a normalization factor of 1; Plate II has a normalization factor of 1875/1969=0.95; Plate III has a normalization factor of 1875/1781=1.05. The equation used to establish these numbers is as follows: "Average average"/line average=normalization factor.

If the normalization factors are different, these factors are incorporated into the data analysis. The sample data on each plate is then multiplied by the normalization factor to obtain normalized volume values.

B. The Capture/Detection System.

A 96-well dot blot apparatus is typically used to capture the DNA:protein complexes on a nitrocellulose filter as described in Example 10.

C. Quantitatior of Data.

The autoradiographs of the nitrocellulose filters are analyzed as described in Example 10.

D. Analysis of Data.

After densitometry, the data is analyzed using a spreadsheet program, such as "EXCEL." For each plate, the calibrator samples are examined and used to determine the normalization value. Then, for each test oligonucleotide, at each drug concentration and/or each time point, a normalized % score is calculated. The normalized % score (n %) can be described as follows:

$$n \% = (nT/nC) \times 100,$$

where (i) nT is the densitometry volume of the test sample multiplied by the normalization factor for the plate from which the sample was obtained, and (ii) nC is the densitometry volume of the control sample multiplied by the normalization factor for the plate from which the sample was obtained. The oligonucleotides are then ranked from 1 to 256 based on their n % scores.

While the invention has been described with reference to specific methods and embodiments, it will be appreciated that various modifications and changes may be made without departing from the invention.

SEQUENCE LISTING (664 sequences)

SEQ ID NO: 1 - DNA (genomic), 42 bp; double-stranded, linear
  hypothetical: NO
  original source individual isolate: Human ferredoxin gene
gctctgcttgccaatgtctttataggtcacccggaaggcacg

SEQ ID NO: 2 - DNA (genomic), 44 bp; double-stranded, linear
  hypothetical: NO
  original source individual isolate: Human macrophage alpha1-antitrypsin
cctactgcctccacccgaagtctacttcctgggtgggcaggaac

SEQ ID NO: 3 - DNA (genomic), 46 bp; double-stranded, linear
  hypothetical: NO
  original source individual isolate: Human gene B for alpha 1-acid glycoprotein
agtgaccgcccatagtttattataaaggtgactgcaccctgcagcc

SEQ ID NO: 4 - DNA (genomic), 47 bp; double-stranded, linear
  hypothetical: NO
  original source individual isolate: Human gene for alpha 1 microtubulin-bikunin
attggagctgtccttggggctgtaattggccccagctgagcagggca

SEQ ID NO: 5 - DNA (genomic), 45 bp; double-stranded, linear
  hypothetical: NO
  original source individual isolate: Human gene for alpha-2 macroglobulin
ctgtttgcacacagagcagcataaagcccagttgctttgggaagt

SEQ ID NO: 6 - DNA (genomic), 48 bp; double-stranded, linear
  hypothetical: NO
  original source individual isolate: Human ACAA gene for peroxisomal 3-oxoacyl-CoA
ctcgggtttggctacaaaaggtggaaagacttccggtctgcatttctg

SEQ ID NO: 7 - DNA (genomic), 48 bp; double-stranded, linear
  hypothetical: NO
  original source individual isolate: Human ACAA gene for peroxisomal 3-oxoacyl-CoA
caaggtaggcggggcattgagtggaaagctcggctgggcggtgcctgt

SEQ ID NO: 8 - DNA (genomic), 48 bp; double-stranded, linear
  hypothetical: NO
  original source individual isolate: Human choline acetyltransferase gene
gcaattgtgacccacagcctaataataacagtctttgccctcttggcc

SEQ ID NO: 9 - DNA (genomic), 45 bp; double-stranded, linear
  hypothetical: NO
  original source individual isolate: Human angiotensin I-converting enzyme gene
ggcgggggtgtgtcgggttttataacccgcagggcggccgcggcg

SEQ ID NO: 10 - DNA (genomic), 45 bp; double-stranded, linear
  hypothetical: NO
  original source individual isolate: Human gene fragment for the acetylcholine receptor gamma
ggggtgggagtgtaggctgttatatgacacccagagcccatctct

SEQ ID NO: 11 - DNA (genomic), 46 bp; double-stranded, linear
  hypothetical: NO
  original source individual isolate: Human cytokine (Act-2) gene
gtcctaggcctcagagtccctataaagagagattcccaactcagta

SEQ ID NO: 12 - DNA (genomic), 45 bp; double-stranded, linear
  hypothetical: NO
  original source individual isolate: Human beta-actin gene
ggtgagtgagcggcgcggggccaatcgcgtgcgccgttccgaaag

SEQ ID NO: 13 - DNA (genomic), 47 bp; double-stranded, linear
  hypothetical: NO
  original source individual isolate: Human beta-actin gene
gagcggccgcggcggcgccctataaaacccagcggcgcgacgcgcca

SEQ ID NO: 14 - DNA (genomic), 50 bp; double-stranded, linear
  hypothetical: NO
  original source individual isolate: Human cardiac actin gene
tgctccaactgaccctgtccatcagcgttctataaagcggccctcctgga

SEQ ID NO: 15 - DNA (genomic), 47 bp; double-stranded, linear
  hypothetical: NO
  original source individual isolate: Human gene for vascular smooth muscle alpha-actin
gaggagagcaggccaagggctatataacccttcagctttcagcttcc

SEQ ID NO: 16 - DNA (genomic), 44 bp; double-stranded, linear
  hypothetical: NO
  original source individual isolate: Human enteric smooth muscle gamma-actin gene
aagatccgcctctggggttttatattgctctggtattcatgcca

SEQ ID NO: 17 - DNA (genomic), 46 bp; double-stranded, linear
  hypothetical: NO
  original source individual isolate: Human arachidonate 12-lipoxygenase gene
gcggggccgcagaccggtcctttaaaggttggaagtggccccgagg

SEQ ID NO: 18 - DNA (genomic), 48 bp; double-stranded, linear
  hypothetical: NO
  original source individual isolate: Human alcohal dehydrogenase alpha subunit (ADH1) gene
ggtgttattcaagcaaaaaaaataaataaatacctatgcaatacacct

SEQ ID NO: 19 - DNA (genomic), 48 bp; double-stranded, linear
  hypothetical: NO
  original source individual isolate: Human alcohal dehydrogenase beta subunit gene
gatgttacacaagcaaacaaaataaatatctgtgcaatatatctgctt

SEQ ID NO: 20 - DNA (genomic), 50 bp; double-stranded, linear
  hypothetical: NO
  original source individual isolate: Human alpha-fetoprotein gene
taacaggcattgcctgaaaagagtataaaagaatttcagcatgattttcc

SEQ ID NO: 21 - DNA (genomic), 47 bp; double-stranded, linear
  hypothetical: NO
  original source individual isolate: Human cytosolic adenylate kinase gene
atgccgcgcgctgacagccttataaatagtcgcctttgccggccgcc

SEQ ID NO: 22 - DNA (genomic), 50 bp; double-stranded, linear
  hypothetical: NO
  original source individual isolate: Human alpha-N-acetylgalactosaminidase (AK1) gene
cggacttatcaggttaccggattcgagtcagaagcggcggcaggtctgaa

SEQ ID NO: 23 - DNA (genomic), 46 bp; double-stranded, linear
  hypothetical: NO
  original source individual isolate: Human ALAD gene for porphobilinogen synthase
ataaagacctttgatcggatctatcattgtacctatcataggtctg

SEQ ID NO: 24 - DNA (genomic), 46 bp; double-stranded, linear
  hypothetical: NO
  original source individual isolate: Human ALAD gene for porphobilinogen synthase
ccctaccaaggaggaagactggataaaatggcctgagatggctgaa

SEQ ID NO: 25 - DNA (genomic), 58 bp; double-stranded, linear
  hypothetical: NO
  original source individual isolate: Human albumin gene
gagagtgacaaaggcctgaatttgtcaattagtaacaattgtattcaacagtaaggat

SEQ ID NO: 26 - DNA (genomic), 45 bp; double-stranded, linear
  hypothetical: NO
  original source individual isolate: Human aldolase A gene
ctgctcaccacacacaagtgttataggaggagtctggcccttgag

SEQ ID NO: 27 - DNA (genomic), 45 bp; double-stranded, linear
  hypothetical: NO
  original source individual isolate: Human aldolase C gene for fructose 1,6-bisphosphate aldolase
acctgcaatacccccttaccccaataccaagaccaactggcatag

SEQ ID NO: 28 - DNA (genomic), 70 bp; double-stranded, linear
  hypothetical: NO
  original source individual isolate: Human aldolase C gene
ggcatagagccaactgagataaatgctatttaaataaagtgtatttaatgaatttctccaagcttacgga

SEQ ID NO: 29 - DNA (genomic), 45 bp; double-stranded, linear
  hypothetical: NO
  original source individual isolate: Human aldolase A gene
cctccacacgtcaacgattctatttgaagttgggcagggggtggc

SEQ ID NO: 30 - DNA (genomic), 43 bp; double-stranded, linear
  hypothetical: NO
  original source individual isolate: Human aldolase A gene
attagagaagatcggggacacatgtggggctgggcaggagctg

SEQ ID NO: 31 - DNA (genomic), 45 bp; double-stranded, linear
  hypothetical: NO
  original source individual isolate: Human aldolase A gene
gggctgggcaggagctgccttataaccacccgggaacccctagct

SEQ ID NO: 32 - DNA (genomic), 46 bp; double-stranded, linear
  hypothetical: NO
  original source individual isolate: Human aldolase A gene
gcggagggcggagtggtgcctttaaaaggccggcgccgccttccgc

SEQ ID NO: 33 - DNA (genomic), 45 bp; double-stranded, linear
  hypothetical: NO
  original source individual isolate: Human aldolase A gene
tgcgccgccccttccgaggctaaatcgcttcctctcggaacgcgc

SEQ ID NO: 34 - DNA (genomic), 45 bp; double-stranded, linear
  hypothetical: NO
  original source individual isolate: Human aldolase B gene
aaaaaacatgatgagaagtctataaaaattgtgtgctaccaaaga

SEQ ID NO: 35 - DNA (genomic), 50 bp; double-stranded, linear
  hypothetical: NO
  original source individual isolate: Human leukemia inhibitory factor (LIF) gene
cttacaacacaggctccagtatataaatcaggcaaattccccatttgagc

SEQ ID NO: 36 - DNA (genomic), 46 bp; double-stranded, linear
  hypothetical: NO
  original source individual isolate: Human aminopeptidase N gene
ggggctcctcccctttggggatataagcccggcctggggctgctcc

SEQ ID NO: 37 - DNA (genomic), 47 bp; double-stranded, linear
  hypothetical: NO
  original source individual isolate: Human alpha-amylase gene
aaatgtgcttcttacaggaatataaatagtttctggaaaggacactg

SEQ ID NO: 38 - DNA (genomic), 47 bp; double-stranded, linear
  hypothetical: NO
  original source individual isolate: Human amyloid-beta protein gene
gggaggcctgcggggtcggatgattcaagctcacggggacgagcagg

SEQ ID NO: 39 - DNA (genomic), 54 bp; double-stranded, linear
  hypothetical: NO
  original source individual isolate: Human amyloid beta protein
cggggacgagcaggagcgctctcgacttttctagagcctcagcgtcctaggact

SEQ ID NO: 40 - DNA (genomic), 47 bp; double-stranded, linear
  hypothetical: NO
  original source individual isolate: Human amyloid-beta protein
gcggggtgggccggatcagctgactcgcctggctctgagccccgccg

SEQ ID NO: 41 - DNA (genomic), 50 bp; double-stranded, linear
  hypothetical: NO
  original source individual isolate: Human amyloid-beta protein (APP) gene
tcagctgactcgcctggctctgagccccgccgccgcgctcgggctccgtc

SEQ ID NO: 42 - DNA (genomic), 46 bp; double-stranded, linear
  hypothetical: NO
  original source individual isolate: Human pronatriodilatin precursor gene
tgcttggagagctggggggctataaaaagaggcggcactgggcagc

SEQ ID NO: 43 - DNA (genomic), 49 bp; double-stranded, linear
  hypothetical: NO
  original source individual isolate: Human gene for atrial natriuretic factor
ttgaagtgggagcctcttgagtcaaatcagtaagaatgcggctcttgca

SEQ ID NO: 44 - DNA (genomic), 49 bp; double-stranded, linear
  hypothetical: NO
  original source individual isolate: Human gene for atrial natriuretic factor
ctgcggatgataactttaaaagggcatctcctgctggcttctcacttgg

SEQ ID NO: 45 - DNA (genomic), 46 bp; double-stranded, linear; identical to SEQ ID NO: 42
  hypothetical: NO
  original source individual isolate: Human gene for atrial natriuretic factor

SEQ ID NO: 46 - DNA (genomic), 50 bp; double-stranded, linear
  hypothetical: NO
  original source individual isolate: Human atrial natriuretic factor
cttggagagctggggggctataaaaagaggcggcactgggcagctgggag

SEQ ID NO: 47 - DNA (genomic), 46 bp; double-stranded, linear
  hypothetical: NO
  original source individual isolate: Human angiotensinogen gene
ctccatccccacccctcagctataaatagggcctcgtgacccggcc

SEQ ID NO: 48 - DNA (genomic), 45 bp; double-stranded, linear
  hypothetical: NO
  original source individual isolate: Human heart/skeletal muscle ATP/ADP translocator gene
tcgcgagagcccggcggggatataagggggagctgcgggccaggc

SEQ ID NO: 49 - DNA (genomic), 49 bp; double-stranded, linear
  hypothetical: NO
  original source individual isolate: Human apolipoprotein CIII gene
tctggacaccctgcctcaggccctcatctccactggtcagcaggtgacc

SEQ ID NO: 50 - DNA (genomic), 49 bp; double-stranded, linear
  hypothetical: NO
  original source individual isolate: Human apolipoprotein CIII gene
ctcaggccctcatctccactggtcagcaggtgacctttgcccagcgccc

SEQ ID NO: 51 - DNA (genomic), 48 bp; double-stranded, linear
  hypothetical: NO
  original source individual isolate: Human apolipoprotein CIII gene
tgcctgctgccctggagatgatataaaacaggtcagaaccctcctgcc

SEQ ID NO: 52 - DNA (genomic), 50 bp; double-stranded, linear
  hypothetical: NO
  original source individual isolate: Human apolipoprotein CIII gene
gacaccctgcctcaggccctcatctccactggtcagcaggtgacctttgc

SEQ ID NO: 53 - DNA (genomic), 48 bp; double-stranded, linear; identical to SEQ ID NO: 51
  hypothetical: NO
  original source individual isolate: Human apolipoprotein CIII gene

SEQ ID NO: 54 - DNA (genomic), 49 bp; double-stranded, linear
  hypothetical: NO
  original source individual isolate: Human apolipoprotein AII gene
ataatccctgccccactgggcccatccatagtccctgtcacctgacagg

SEQ ID NO: 55 - DNA (genomic), 46 bp; double-stranded, linear
  hypothetical: NO
  original source individual isolate: Human apolipoprotein AII gene
ggggtgggtaaacagacaggtatatagccccttcctctccagccag

SEQ ID NO: 56 - DNA (genomic), 33 bp; double-stranded, linear
  hypothetical: NO
  original source individual isolate: Human fetal gene for apolipoprotein AI precursor
ctgcagacataaataggccctgcaagagctggc

SEQ ID NO: 57 - DNA (genomic), 39 bp; double-stranded, linear
  hypothetical: NO
  original source individual isolate: Human apolipoprotein B gene
gcctgggcttcctataaatggggtgcgggcgccggccgc

SEQ ID NO: 58 - DNA (genomic), 47 bp; double-stranded, linear
  hypothetical: NO
  original source individual isolate: Human apoC-II gene for preproapolipoprotein C-II
cggaagtgggtctcaaccactataaatcctctctgtgcccgtccgga

SEQ ID NO: 59 - DNA (genomic), 47 bp; double-stranded, linear
  hypothetical: NO
  original source individual isolate: Human apolipoprotein C-I (VLDL) gene
tgccccgcccctccccagcctgataaaggtcctgcgggcaggacagg

SEQ ID NO: 60 - DNA (genomic), 47 bp; double-stranded, linear
  hypothetical: NO
  original source individual isolate: Human apolipoprotein D gene
atcagagacctgaagaagcttataaaatagcttgggagaggccagtc

SEQ ID NO: 61 - DNA (genomic), 45 bp; double-stranded, linear
  hypothetical: NO
  original source individual isolate: Human arginase gene
ggttgtttattcaacccaagtataaatggaaaaaaaagatgcgcc

SEQ ID NO: 62 - DNA (genomic), 45 bp; double-stranded, linear
  hypothetical: NO
  original source individual isolate: Human argininosuccinate synthetase gene
ctgcccccgggccctgtgcttataacctgggatgggcacccctgc

SEQ ID NO: 63 - DNA (genomic), 44 bp; double-stranded, linear
  hypothetical: NO
  original source individual isolate: Human sodium/potassium ATPase alpha 3 subunit (ATP1 A3)
cccctcccgcggacgcgggcatatgaggaggcggaggcggcggc

SEQ ID NO: 64 - DNA (genomic), 48 bp; double-stranded, linear
  hypothetical: NO
  original source individual isolate: Human (BSF-2/IL6) gene for B cell stimulatory factor-2
attagagtctcaacccccaataaatataggactggagatgtctgaggc

SEQ ID NO: 65 - DNA (genomic), 51 bp; double-stranded, linear
  hypothetical: NO
  original source individual isolate: Human C5 gene
tctgaattcttcaagttcagtttatttaaaaggagactatcctcaaaagtg

SEQ ID NO: 66 - DNA (genomic), 45 bp; double-stranded, linear
  hypothetical: NO
  original source individual isolate: Human carbonic anhydrase II gene
cctccccttgtcgcctaggtccacccgagccccctcccccgggcc

SEQ ID NO: 67 - DNA (genomic), 46 bp; double-stranded, linear
  hypothetical: NO
  original source individual isolate: Human carbonic anhydrase II gene
gcacgaagttggcgggagcctataaaagcgggccggcgcgacccgc

SEQ ID NO: 68 - DNA (genomic), 45 bp; double-stranded, linear
  hypothetical: NO
  original source individual isolate: Human calcitonin/alpha-CGRP gene
ttcccgacccacagcggcgggaataagagcagtcgctggcgctgg

SEQ ID NO: 69 - DNA (genomic), 47 bp; double-stranded, linear
  hypothetical: NO
  original source individual isolate: Human calretinin gene, exon 1
caggcgcaggctccagagcgtatataagggcagcgtggcgcacaacc

SEQ ID NO: 70 - DNA (genomic), 45 bp; double-stranded, linear
  hypothetical: NO
  original source individual isolate: Human cathepsin G gene
ttccttcctctctcagggccttaaagtctaggaggaggaagcaca

SEQ ID NO: 71 - DNA (genomic), 45 bp; double-stranded, linear
  hypothetical: NO
  original source individual isolate: Human carbonic anhydrase VII (CA VII) gene
ctcctcccgccagccgctgctttaagaggctgctccgcggtagcg

SEQ ID NO: 72 - DNA (genomic), 46 bp; double-stranded, linear
  hypothetical: NO
  original source individual isolate: Human cardiac beta myosin heavy chain gene
tctagtgacaacagccctttctaaatccggctagggactgggtgcc

SEQ ID NO: 73 - DNA (genomic), 45 bp; double-stranded, linear
  hypothetical: NO
  original source individual isolate: Human cardiac beta myosin heavy chain gene
tgggggtgcctgctgccccatatatacagcccctgagaccaggtc

SEQ ID NO: 74 - DNA (genomic), 47 bp; double-stranded, linear
  hypothetical: NO
  original source individual isolate: Human complement C3 gene
tgggggaaagcaggagccagataaaaagccagctccagcaggcgctg

SEQ ID NO: 75 - DNA (genomic), 50 bp; double-stranded, linear
  hypothetical: NO
  original source individual isolate: Human recognition/surface antigen (CD4) gene
caagtcctcacacagatacgcctgtttgagaagcagcgggcaagaaagac

SEQ ID NO: 76 - DNA (genomic), 50 bp; double-stranded, linear
  hypothetical: NO
  original source individual isolate: Human hyaluronate receptor gene (CD44)
taggtcactgttttcaacctcgaataaaaactgcagccaacttccgaggc

SEQ ID NO: 77 - DNA (genomic), 50 bp; double-stranded, linear
  hypothetical: NO
  original source individual isolate: Human cystic fibrosis transmembrane conductance reg. gene
aatgacatcacagcaggtcagagaaaaagggttgagcggcaggcacccag

SEQ ID NO: 78 - DNA (genomic), 46 bp; double-stranded, linear
  hypothetical: NO
  original source individual isolate: Human cholesterol 7-alpha-hydroxylase (CYP7) gene
atggatctggatactatgtatataaaaagcctagcttgagtctctt

SEQ ID NO: 79 - DNA (genomic), 49 bp; double-stranded, linear
  hypothetical: NO
  original source individual isolate: Human choline acetyltransferase gene
agcaattgtgacccacagcctaataataacagtctttgccctcttggcc

SEQ ID NO: 80 - DNA (genomic), 46 bp; double-stranded, linear
  hypothetical: NO
  original source individual isolate: Human mast cell chymase gene
ctctcttgccttctaggagttataaaacccaagactggaaaggaaa

SEQ ID NO: 81 - DNA (genomic), 47 bp; double-stranded, linear
  hypothetical: NO
  original source individual isolate: Human heart chymase gene
cctctcttgccttctgggagttataaaacccaagactggaaggaaaa

SEQ ID NO: 82 - DNA (genomic), 48 bp; double-stranded, linear
  hypothetical: NO
  original source individual isolate: Human creatine kinase B gene
ggccaatggaatgaatgggctataaatagccgccaatgggcggcccgc

SEQ ID NO: 83 - DNA (genomic), 46 bp; double-stranded, linear
  hypothetical: NO
  original source individual isolate: Human C-type natriuretic peptide gene
acatcagcggcaggttggattataaaggcgcgagcagagtcacggg

SEQ ID NO: 84 - DNA (genomic), 45 bp; double-stranded, linear
  hypothetical: NO
  original source individual isolate: Human transmembrane protein (CD59) gene
gctccgcgcgggggtggagggagaggaggaggttcctgccgaggt

SEQ ID NO: 85 - DNA (genomic), 46 bp; double-stranded, linear
  hypothetical: NO
  original source individual isolate: Human transmembrane protein (CD59) gene
gagggcaagggcatcctgaggggcggggccgggggcggagccttgc

SEQ ID NO: 86 - DNA (genomic), 46 bp; double-stranded, linear
  hypothetical: NO
  original source individual isolate: Human transmembrane protein (CD59) gene
atcctgaggggcggggccgggggcggagccttgcgggctggagcga

SEQ ID NO: 87 - DNA (genomic), 50 bp; double-stranded, linear
  hypothetical: NO
  original source individual isolate: Human transmembrane protein (CD59) gene
tgaggggcggggccgggggcggagccttgcgggctggagcgaaagaatgc

SEQ ID NO: 88 - DNA (genomic), 46 bp; double-stranded, linear
  hypothetical: NO
  original source individual isolate: Human myeloid specific CD11b gene
gccctcttcctttgaatctctgatagacttctgcctcctacttctc

SEQ ID NO: 89 - DNA (genomic), 46 bp; double-stranded, linear
  hypothetical: NO
  original source individual isolate: Human cholesteryl ester transferase protein (CETP) gene
gtgggggctgggcggacatacatatacgggctccaggctgaacggc

SEQ ID NO: 90 - DNA (genomic), 45 bp; double-stranded, linear
  hypothetical: NO
  original source individual isolate: Human cystic fibrosis transmembrane conductance regulator
tgggtggggggaattggaagcaaatgacatcacagcaggtcagag

SEQ ID NO: 91 - DNA (genomic), 47 bp; double-stranded, linear
  hypothetical: NO
  original source individual isolate: Human cystic fibrosis transmembrane conductance regulator
gtggggggaattggaagcaaatgacatcacagcaggtcagagaaaaa

SEQ ID NO: 92 - DNA (genomic), 46 bp; double-stranded, linear
  hypothetical: NO
  original source individual isolate: Human coseg gene for vasopressin-neurophysin precursor
cacgggaacacctgcggacataaataggcagccagcagaggcagca

SEQ ID NO: 93 - DNA (genomic), 46 bp; double-stranded, linear
  hypothetical: NO
  original source individual isolate: Human creatine kinase gene
ttcagagaaagggcaggtgctataaagggcccagcgccacgggcct

SEQ ID NO: 94 - DNA (genomic), 47 bp; double-stranded, linear
  hypothetical: NO
  original source individual isolate: Human alpha-B-crystallin gene
agaagcttcacaagactgcatatataaggggctggctgtagctgcag

SEQ ID NO: 95 - DNA (genomic), 50 bp; double-stranded, linear
  hypothetical: NO
  original source individual isolate: Human C3 gene
agtgggggaaagcagagccagataaaaagccagctccagcaggcgctgct

SEQ ID NO: 96 - DNA (genomic), 46 bp; double-stranded, linear
  hypothetical: NO
  original source individual isolate: Human colony stimulating factor CSF-1 gene
gcctggccagggtgatttcccataaaccacatgccccccagtcctc

SEQ ID NO: 97 - DNA (genomic), 44 bp; double-stranded, linear
  hypothetical: NO
  original source individual isolate: Human cytotoxic serine proteinase gene
gttactcagcagcaggggtgtaaatgtgacagtgccatgtcaac

SEQ ID NO: 98 - DNA (genomic), 46 bp; double-stranded, linear
  hypothetical: NO
  original source individual isolate: Human CST3 gene for cystatin C
ggcggcgaaggccggaagggataaaaccgcagtcgccggcctcgcg

SEQ ID NO: 99 - DNA (genomic), 45 bp; double-stranded, linear
  hypothetical: NO
  original source individual isolate: Human CST4 gene for Cystatin D
ttgggggacacccaagtaggataaatgcacagctagcttctggcc

SEQ ID NO: 100 - DNA (genomic), 45 bp; double-stranded, linear
  hypothetical: NO
  original source individual isolate: Human CYP2C8 gene for cytochrome P-450
actaaattagcagggagtgttataaaaactttggagtgcaagctc

SEQ ID NO: 101 - DNA (genomic), 45 bp; double-stranded, linear
  hypothetical: NO
  original source individual isolate: Human cholesterol desmolase cytochrome gene
agcaggaggaaggacgtgaacattttatcagcttctggtatggcc

SEQ ID NO: 102 - DNA (genomic), 46 bp; double-stranded, linear
  hypothetical: NO
  original source individual isolate: Human cholesterol desmolase cytochrome P-450 gene
tatggccttgagctggtagttataatcttggccctggtggcccagg

SEQ ID NO: 103 - DNA (genomic), 47 bp; double-stranded, linear
  hypothetical: NO
  original source individual isolate: Human steriod 11-beta-hydroxylase (CYP11B1) gene
gaaggcaaggcaccaggcaagataaaaggattgcagctgaacagggt

SEQ ID NO: 104 - DNA (genomic), 47 bp; double-stranded, linear
  hypothetical: NO
  original source individual isolate: Human CYPXI gene for steroid 18-hydroxylase (P-450 C18)
cagagcaggttcctgggtgagataaaaggatttgggctgaacagggt

SEQ ID NO: 105 - DNA (genomic), 46 bp; double-stranded, linear
  hypothetical: NO
  original source individual isolate: Human CYPXIX aromatase P-450 gene
tggacaataaatgaaatctccataaaaggcccaaaggacagggttc

SEQ ID NO: 106 - DNA (genomic), 46 bp; double-stranded, linear
  hypothetical: NO
  original source individual isolate: Human decay-accelerating factor (DAF) gene
agcccagaccccgcccaaagcactcatttaactggtattgcggagc

SEQ ID NO: 107 - DNA (genomic), 45 bp; double-stranded, linear
  hypothetical: NO
  original source individual isolate: Human dopamine beta-hydroxylase gene
acgtccatgtgtcattagtgccaattagaggagggcagcaggctg

SEQ ID NO: 108 - DNA (genomic), 46 bp; double-stranded, linear
  hypothetical: NO
  original source individual isolate: Human dopamine beta-hydroxylase gene
accccattcaggaccagggcataaatggccaggtgggaccagagag

SEQ ID NO: 109 - DNA (genomic), 46 bp; double-stranded, linear
  hypothetical: NO
  original source individual isolate: Human desmin gene
ggggctgatgtcaggagggatacaaatagtgccgacggctgggggc

SEQ ID NO: 110 - DNA (genomic), 45 bp; double-stranded, linear
  hypothetical: NO
  original source individual isolate: Human cytokeratin 8 (CK8) gene
cccggggctgggatctcttttataaaaggccattcctgagagctc

SEQ ID NO: 111 - DNA (genomic), 50 bp; double-stranded, linear
  hypothetical: NO
  original source individual isolate: Human DNA polymerase alpha gene
gcctcccgagccgctgattggctttcaggctggcgcctgtctcggccccc

SEQ ID NO: 112 - DNA (genomic), 50 bp; double-stranded, linear
  hypothetical: NO
  original source individual isolate: Human dopamine D1A receptor gene
gctgtgccccgcgggaaccccgccggcctgtgcgcttgctggtgccagct

SEQ ID NO: 113 - DNA (genomic), 47 bp; double-stranded, linear
  hypothetical: NO
  original source individual isolate: Human eosinophil cationic protein (ECP) gene
agacccaccaagggaagctttatttaaacagttccaagtaggggaga

SEQ ID NO: 114 - DNA (genomic), 50 bp; double-stranded, linear
  hypothetical: NO
  original source individual isolate: Human HER2 gene
gaggaggagggctgcttgaggaagtataagaatgaagttgtgaagctgag

SEQ ID NO: 115 - DNA (genomic), 46 bp; double-stranded, linear
  hypothetical: NO
  original source individual isolate: Human elastin gene
gtgtctcgctgtgatagatcaataaatattttattttttgtcctgg

SEQ ID NO: 116 - DNA (genomic), 49 bp; double-stranded, linear
  hypothetical: NO
  original source individual isolate: Human endothelial leukocyte adhesion molecule I (ELAM-1)
attcacaggaagcaatccctcctataaaagggcctcagccgaagtagtg

SEQ ID NO: 117 - DNA (genomic), 47 bp; double-stranded, linear
  hypothetical: NO
  original source individual isolate: Human eosinophil major basic protein gene
ggaagttcctccaaggcctctatataagaagtctttgtgagaggaag

SEQ ID NO: 118 - DNA (genomic), 49 bp; double-stranded, linear
  hypothetical: NO
  original source individual isolate: Human preproenkephalin B gene
ctctaggaaagtttctcagctctcaaacctctgttttctcatctgcaag

SEQ ID NO: 119 - DNA (genomic), 50 bp; double-stranded, linear
  hypothetical: NO
  original source individual isolate: Human preproenkephalin B gene
ttctcatctgcaagatggggataatattaaccaactggctaggtcatgag

SEQ ID NO: 120 - DNA (genomic), 46 bp; double-stranded, linear
  hypothetical: NO
  original source individual isolate: Human ENO3 gene for muscle-specific enolase
ggggaccgagtggctcagggataaatgcgcacctgagagggggtga

SEQ ID NO: 121 - DNA (genomic), 47 bp; double-stranded, linear
  hypothetical: NO
  original source individual isolate: Human eosinophil derived neurotoxin gene
caacccaccaagggatgctttatttaaacagttccaagtaggggaga

SEQ ID NO: 122 - DNA (genomic), 46 bp; double-stranded, linear
  hypothetical: NO
  original source individual isolate: Human erythropoietin receptor
tacccaggctgagtgctggccccgccccctcggggatctgccactt

SEQ ID NO: 123 - DNA (genomic), 45 bp; double-stranded, linear
  hypothetical: NO
  original source individual isolate: Human c-erb B2/neu protein gene
aggagggctgcttgaggaagtataagaatgaagttgtgaagctga

SEQ ID NO: 124 - DNA (genomic), 49 bp; double-stranded, linear
  hypothetical: NO
  original source individual isolate: Human ERCC2 gene
ccgattggctctgccctagcggattgacgggcaggttagccaatggtct

SEQ ID NO: 125 - DNA (genomic), 47 bp; double-stranded, linear
  hypothetical: NO
  original source individual isolate: Human ERCC2 gene
caggttagccaatggtctcgtaatataggtggagcgagccctcgagg

SEQ ID NO: 126 - DNA (genomic), 50 bp; double-stranded, linear
  hypothetical: NO
  original source individual isolate: Human erythropoietin gene
ggtcacccggcgcgccccaggtcgctgagggaccccggccaggcgcggag

SEQ ID NO: 127 - DNA (genomic), 48 bp; double-stranded, linear
  hypothetical: NO
  original source individual isolate: Human oestrogen receptor
atatgagctcgggagaccagtacttaaagttggaggcccgggagccca

SEQ ID NO: 128 - DNA (genomic), 46 bp; double-stranded, linear
  hypothetical: NO
  original source individual isolate: Human elastase I gene
agctttgctgctaagaggagtataaagagggcttggtccaagcaag

SEQ ID NO: 129 - DNA (genomic), 44 bp; double-stranded, linear
  hypothetical: NO
  original source individual isolate: Human fibrinogen gamma chain gene
ggccccgtgatcagctccagccatttgcagtcctggctatccca

SEQ ID NO: 130 - DNA (genomic), 45 bp; double-stranded, linear
  hypothetical: NO
  original source individual isolate: Human fibrinogen gamma chain gene
tggctatcccaggagcttacataaagggacaattggagcctgaga

SEQ ID NO: 131 - DNA (genomic), 45 bp; double-stranded, linear
  hypothetical: NO
  original source individual isolate: Human lymphocyte IgE receptor gene
ttaacatctctagttctcacccaattctcttacctgagaaatgga

SEQ ID NO: 132 - DNA (genomic), 47 bp; double-stranded, linear
  hypothetical: NO
  original source individual isolate: Human lymphocyte IgE receptor gene
gttatccgggtggcaagcccatatttaggtctatgaaaatagaagct

SEQ ID NO: 133 - DNA (genomic), 46 bp; double-stranded, linear
  hypothetical: NO
  original source individual isolate: Human lymphocyte IgE receptor gene
agcccatatttaggtctatgaaaatagaagctgtcagtggctctac

SEQ ID NO: 134 - DNA (genomic), 45 bp; double-stranded, linear
  hypothetical: NO
  original source individual isolate: Human apoferritin H gene
gggcctgacgccgacgcggctataagagaccacaagcgacccgca

SEQ ID NO: 135 - DNA (genomic), 46 bp; double-stranded, linear
  hypothetical: NO
  original source individual isolate: Human fibrinogen beta gene
tattaactaaggaaaggtaaccatttctgaagtcattcctagcaga

SEQ ID NO: 136 - DNA (genomic), 49 bp; double-stranded, linear
  hypothetical: NO
  original source individual isolate: Human fibrinogen beta gene
attcctagcagaggactcagatatatataggattgaagatctctcagtt

SEQ ID NO: 137 - DNA (genomic), 50 bp; double-stranded, linear
  hypothetical: NO
  original source individual isolate: Human factor IX gene
ccagaagtaaatacagctcagcttgtactttggtacaactaatcgacctt

SEQ ID NO: 138 - DNA (genomic), 50 bp; double-stranded, linear
  hypothetical: NO
  original source individual isolate: Human FK506 binding proteins 12A, 12B, and 12C (FKBP12)
gagccgtggaaccgccgccaggtcgctgttggtccacgccgcccgtcgcg

SEQ ID NO: 139 - DNA (genomic), 50 bp; double-stranded, linear
  hypothetical: NO
  original source individual isolate: Human 5-lipoxygenase activating protein (FLAP) gene
ttgtgccggggatcttcagaaattgtaatgatgaaagagtgcaagctctc

SEQ ID NO: 140 - DNA (genomic), 50 bp; double-stranded, linear
  hypothetical: NO
  original source individual isolate: Human fos proto-oncogene (c-fos)
attcataaaacgcttgttataaaagcagtggctgcggcgcctcgtactcc

SEQ ID NO: 141 - DNA (genomic), 45 bp; double-stranded, linear
  hypothetical: NO
  original source individual isolate: Human GOS2 gene
ggcgtgtctcagagaaaagatataagcggcccccggacgctaaag

SEQ ID NO: 142 - DNA (genomic), 46 bp; double-stranded, linear
  hypothetical: NO
  original source individual isolate: Human granulocyte colony-stimulating factor gene
caggcctccatggggttatgtataaagggccccctagagctgggcc

SEQ ID NO: 143 - DNA (genomic), 48 bp; double-stranded, linear
  hypothetical: NO
  original source individual isolate: Human EGR2 gene
cgggtattgaagacctgcccataaatacttagagcaacactttccgtc

SEQ ID NO: 144 - DNA (genomic), 46 bp; double-stranded, linear
  hypothetical: NO
  original source individual isolate: Human growth hormone (hGH) gene
tgggagagaaggggccagggtataaaaagggcccacaagagaccag

SEQ ID NO: 145 - DNA (genomic), 50 bp; double-stranded, linear
  hypothetical: NO
  original source individual isolate: Human gastric inhibitory polypeptide (GIP) mRNA
taatcagcaggtctatgcctaatataaaggagctggggcatgatttcttc

SEQ ID NO: 146 - DNA (genomic), 46 bp; double-stranded, linear
  hypothetical: NO
  original source individual isolate: Human GLA gene for alpha-D-galactosidase A
gaaacaataacgtcattatttaataagtcatcggtgattggtccgc

SEQ ID NO: 147 - DNA (genomic), 44 bp; double-stranded, linear
  hypothetical: NO
  original source individual isolate: Human glucagon gene
tttacagatgagaaatttatattgtcagcgtaatatctgtgagg

SEQ ID NO: 148 - DNA (genomic), 47 bp; double-stranded, linear
  hypothetical: NO
  original source individual isolate: Human glucagon gene
ggctaaacagagctggagagtatataaaagcagtgcgccttggtgca

SEQ ID NO: 149 - DNA (genomic), 47 bp; double-stranded, linear
  hypothetical: NO
  original source individual isolate: Human granulocyte-macrophage colony stimulating factor gene
cattaatcatttcctctgtgtatttaagagctcttttgccagtgagc

SEQ ID NO: 150 - DNA (genomic), 46 bp; double-stranded, linear
  hypothetical: NO
  original source individual isolate: Human glucocorticoid receptor gene
tgggcaatgggagactttcttaaatagggctctccccccacccatg

SEQ ID NO: 151 - DNA (genomic), 50 bp; double-stranded, linear
  hypothetical: NO
  original source individual isolate: Human growth hormone releasing factor (GRF) gene
aacgcttaggaaaatgaagagataaatgatgggaacgccaggcggctgcc

SEQ ID NO: 152 - DNA (genomic), 44 bp; double-stranded, linear
  hypothetical: NO
  original source individual isolate: Human GST pi gene for glutathione S-transferase pi
gagcggggcgggaccacccttataaggctcggaggccgcgaggc

SEQ ID NO: 153 - DNA (genomic), 47 bp; double-stranded, linear
  hypothetical: NO
  original source individual isolate: human glycophorin C (GPC) gene
cagaagtgggcgggtgtgtgtttaaaaaaaaaaaaaggggtggaaac

SEQ ID NO: 154 - DNA (genomic), 46 bp; double-stranded, linear
  hypothetical: NO
  original source individual isolate: Human histone (H10) gene
cgcggtccgcccgccgccgctaaatacccggatgcgccgcccaagc

SEQ ID NO: 155 - DNA (genomic), 44 bp; double-stranded, linear
  hypothetical: NO
  original source individual isolate: Human gene for H1 RNA
gtctttggatttgggaatcttataagttctgtatgagaccactc

SEQ ID NO: 156 - DNA (genomic), 46 bp; double-stranded, linear
  hypothetical: NO
  original source individual isolate: Human H1 histone gene FNC16
ggcggtggattggacgctccaccaatcacagggcagcgccggctta

SEQ ID NO: 157 - DNA (genomic), 54 bp; double-stranded, linear
  hypothetical: NO
  original source individual isolate: Human histone gene FNC16
accaatcacagggcagcgccggcttatataagcccgggcccgagcatagcagca

SEQ ID NO: 158 - DNA (genomic), 47 bp; double-stranded, linear
  hypothetical: NO
  original source individual isolate: Human H2B.2 and H2A.1 genes for Histone H2A and H2B
ttttcgcgcccagcagctgctataaaatgcgcgtccctgtaggttcc

SEQ ID NO: 159 - DNA (genomic), 48 bp; double-stranded, linear
  hypothetical: NO
  original source individual isolate: Human H4/a gene for H4 histone
gggggcaggggtaacgtagatatataaagatcggtttcctattctctc

SEQ ID NO: 160 - DNA (genomic), 56 bp; double-stranded, linear
  hypothetical: NO
  original source individual isolate: Human H4/b gene for H4 histone
ctgcaagtatagtgtgtgtgtatatatatatatatacctagcagtatttattaaat

SEQ ID NO: 161 - DNA (genomic), 50 bp; double-stranded, linear
  hypothetical: NO
  original source individual isolate: Human androgen receptor gene
ggtgggggcgggacccgactcgcaaactgttgcatttgctctccacctcc

SEQ ID NO: 162 - DNA (genomic), 49 bp; double-stranded, linear
  hypothetical: NO
  original source individual isolate: Human chorionic gonadotropin (hCG) beta subunit
gccctctctcattgggcagaagctaagtccgaagccgcgcccctcctgg

SEQ ID NO: 163 - DNA (genomic), 50 bp; double-stranded, linear
  hypothetical: NO
  original source individual isolate: Human islet amyloid polypeptide (hIAPP) gene
gctgagaaaggtgtgaggggtatataagagctggattactagttagcaaa

SEQ ID NO: 164 - DNA (genomic), 52 bp; double-stranded, linear
  hypothetical: NO
  original source individual isolate: Human H4 histone gene
cttcccgccggcgcgctttcggttttcaatctggtccgatatctctgtatat

SEQ ID NO: 165 - DNA (genomic), 47 bp; double-stranded, linear
  hypothetical: NO
  original source individual isolate: Human H4 histone gene
aatctggtccgatatctctgtatattacggggaagacggtgacgctc

SEQ ID NO: 166 - DNA (genomic), 40 bp; double-stranded, linear
  hypothetical: NO
  original source individual isolate: Human histone H2a gene
tcctcttttcttggcgaactcaactggtatgaattcctca

SEQ ID NO: 167 - DNA (genomic), 46 bp; double-stranded, linear
  hypothetical: NO
  original source individual isolate: Human histone H2a gene
cacagcctacctccagtcagtataaatacttctctgccttgcgttc

SEQ ID NO: 168 - DNA (genomic), 47 bp; double-stranded, linear
  hypothetical: NO
  original source individual isolate: Human histone H2b gene
tatttgcataagcgattctatataaaagcgccttgtcataccctgct

SEQ ID NO: 169 - DNA (genomic), 45 bp; double-stranded, linear
  hypothetical: NO
  original source individual isolate: Human histone H3 gene
atttttgaattttcttgggtccaatagttggtggtctgactctat

SEQ ID NO: 170 - DNA (genomic), 47 bp; double-stranded, linear
  hypothetical: NO
  original source individual isolate: Human histone H3 gene
caatagttggtggtctgactctataaaagaagagtagctctttcctt

SEQ ID NO: 171 - DNA (genomic), 45 bp; double-stranded, linear
  hypothetical: NO
  original source individual isolate: Human HLA-A1 gene
agtgtcgtcgcggtcgctgttctaaagtccgcacgcacccaccgg

SEQ ID NO: 172 - DNA (genomic), 46 bp; double-stranded, linear
  hypothetical: NO
  original source individual isolate: Human HLA-B27 antigen gene
agtgtcgccggggtcccagttctaaagtccccacgcacccacccgg

SEQ ID NO: 173 - DNA (genomic), 45 bp; double-stranded, linear
  hypothetical: NO
  original source individual isolate: Human HLA-Bw57 gene
agcgtcgccgcggtcccagttctaaagtccccacgcacccacccg

SEQ ID NO: 174 - DNA (genomic), 46 bp; double-stranded, linear
  hypothetical: NO
  original source individual isolate: Human HLA-F gene for human leukocyte antigen F
tgtcgccgcagttcccaggttctaaagtcccacgcaccccgcggga

SEQ ID NO: 175 - DNA (genomic), 46 bp; double-stranded, linear
  hypothetical: NO
  original source individual isolate: Human gene for histocompatibility antigen HLA-A3
agtgtcgtcgcggtcgctgttctaaagcccgcacgcacccaccggg

SEQ ID NO: 176 - DNA (genomic), 42 bp; double-stranded, linear
  hypothetical: NO
  original source individual isolate: Human gene for class I histocompatibility antigen HLA-CW3
cattgggtgtcggacctctagaaggccggtcagcgtctccgc

SEQ ID NO: 177 - DNA (genomic), 46 bp; double-stranded, linear
  hypothetical: NO
  original source individual isolate: Human HMG-17 gene for non-histone chromosomal protein
cggtccggggctcccagcgctataaaaactttataaaccccccgga

SEQ ID NO: 178 - DNA (genomic), 46 bp; double-stranded, linear
  hypothetical: NO
  original source individual isolate: Human HOX3D gene for homeoprotein HOX3D
aagaaagagatatctccacctataaattgtccactttggagaacaa

SEQ ID NO: 179 - DNA (genomic), 45 bp; double-stranded, linear
  hypothetical: NO
  original source individual isolate: Human 71Kd heat shock cognate protein (hsc70)
tggaaggttctaagatagggtataagaggcagggtggcgggcgga

SEQ ID NO: 180 - DNA (genomic), 50 bp; double-stranded, linear
  hypothetical: NO
  original source individual isolate: Human heat shock protein (hsp 70) gene
aaggcgggtctccgtgacgacttataaaagcccaggggcaagcggtccgg

SEQ ID NO: 181 - DNA (genomic), 46 bp; double-stranded, linear
  hypothetical: NO
  original source individual isolate: Human hsp70B gene
cttcggtctcacggaccgatccgcccgaaccttctcccggggtcag

SEQ ID NO: 182 - DNA (genomic), 46 bp; double-stranded, linear
  hypothetical: NO
  original source individual isolate: Human hsp70B gene
ccgcccggctgactcagcccgggcgggcgggcgggaggctctcgac

SEQ ID NO: 183 - DNA (genomic), 46 bp; double-stranded, linear
  hypothetical: YES
  original source individual isolate: Human hsp70B gene
ccggctgactcagcccgggcgggcgggcgggaggctctcgactggg

SEQ ID NO: 184 - DNA (genomic), 46 bp; double-stranded, linear
  hypothetical: NO
  original source individual isolate: Human hsp70B gene
ctgactcagcccgggcgggcgggcgggaggctctcgactgggcggg

SEQ ID NO: 185 - DNA (genomic), 45 bp; double-stranded, linear
  hypothetical: NO
  original source individual isolate: Human hsp70B gene
gggcgggcgggaggctctcgactgggcgggaaggtgcgggaaggt

SEQ ID NO: 186 - DNA (genomic), 53 bp; double-stranded, linear
  hypothetical: NO
  original source individual isolate: Human hsp70B gene
cggcggggtcggggaggtgcaaaaggatgaaaagcccgtggacggagctgagc

SEQ ID NO: 187 - DNA (genomic), 47 bp; double-stranded, linear
  hypothetical: NO
  original source individual isolate: Human IAPP gene for islet amyloid polypeptide
gctgagaaaggtgtgaggggtatataagagctggattactagttagc

SEQ ID NO: 188 - DNA (genomic), 46 bp; double-stranded, linear
  hypothetical: NO
  original source individual isolate: Human intercellular adhesion molecule 1 (ICAM-1) gene
aggtttccgggaaagcagcaccgccccttggcccccaggtggctag

SEQ ID NO: 189 - DNA (genomic), 46 bp; double-stranded, linear
  hypothetical: NO
  original source individual isolate: Human intercellular adhesion molecule 1 (ICAM-1) gene
ggcccccaggtggctagcgctataaaggatcacgcgccccagtcga

SEQ ID NO: 190 - DNA (genomic), 48 bp; double-stranded, linear
  hypothetical: NO
  original source individual isolate: Human interferon-inducible gene IFI-54K
aaaggaaccagaggccactgtatatataggtctcttcagcatttattg

SEQ ID NO: 191 - DNA (genomic), 48 bp; double-stranded, linear
  hypothetical: NO
  original source individual isolate: Human interferon alpha gene IFN-alpha 14
atggaagctagtatgttccttatttaagacctatgcacagagcaaggt

SEQ ID NO: 192 - DNA (genomic), 45 bp; double-stranded, linear
  hypothetical: NO
  original source individual isolate: Human interferon alpha gene IFN-alpha 16
gaaattagtatgttcactatttaagaactatgcacagagcaaagt

SEQ ID NO: 193 - DNA (genomic), 48 bp; double-stranded, linear
  hypothetical: NO
  original source individual isolate: Human interferon alpha gene IFN-alpha 5
atggaaactcgtatgtgacctttttaagatctgtgcacaaaacaaggt

SEQ ID NO: 194 - DNA (genomic), 48 bp; double-stranded, linear
  hypothetical: NO
  original source individual isolate: Human interferon alpha gene IFN-alpha 6
atggaaactagtatgttccctatttaagacctacacataaagcaaggt

SEQ ID NO: 195 - DNA (genomic), 48 bp; double-stranded, linear
  hypothetical: NO
  original source individual isolate: Human interferon alpha gene IFN-alpha 7
atggaaattagtatgttcactatttaagacctatgcacagagcaaagt

SEQ ID NO: 196 - DNA (genomic), 50 bp; double-stranded, linear
  hypothetical: NO
  original source individual isolate: Human immune interferon (INF-gamma) gene
tcctcaggagacttcaattaggtataaataccagcagccagaggaggtgc

SEQ ID NO: 197 - DNA (genomic), 45 bp; double-stranded, linear
  hypothetical: NO
  original source individual isolate: Human  alpha/beta-interferon (IFN)-inducible 6-16 gene
gggaggatccacaagtgatgataaaaagccagccttcagccggag

SEQ ID NO: 198 - DNA (genomic), 47 bp; double-stranded, linear
  hypothetical: NO
  original source individual isolate: Human insulin like growth factor II (IGF-2)
ctgggaggagtcggctcacacataaaagctgaggcactgaccagcct

SEQ ID NO: 199 - DNA (genomic), 45 bp; double-stranded, linear
  hypothetical: NO
  original source individual isolate: Human insulin-like growth factor binding protein gene
gtggcgcggcctgtgccctttataaggtgcgcgctgtgtccagcg

SEQ ID NO: 200 - DNA (genomic), 48 bp; double-stranded, linear
  hypothetical: NO
  original source individual isolate: Human germline leader peptide and variable region of 1154
caacctcctgcactgaagccttattaataggctggccacacttcatgc

SEQ ID NO: 201 - DNA (genomic), 48 bp; double-stranded, linear
  hypothetical: NO
  original source individual isolate: Human germline for leader peptide & variable region of 2908
caacctcctgccctgaagacttattaataggctggacacacttcatgc

SEQ ID NO: 202 - DNA (genomic), 48 bp; double-stranded, linear
  hypothetical: NO
  original source individual isolate: Human rearranged kappa immunoglobulin subgroup V
ccacgaccaggtgtttggattttataaacgggccgtttgcattgtgaa

SEQ ID NO: 203 - DNA (genomic), 48 bp; double-stranded, linear
  hypothetical: NO
  original source individual isolate: Human rearranged kappa immunoglobulin gene subgroup V
cgccctgcagtccagagcccatatcaatgcctgggtcagagctctgga

SEQ ID NO: 204 - DNA (genomic), 48 bp; double-stranded, linear
  hypothetical: NO
  original source individual isolate: Human germline fragment for immunoglobulin kappa light chain
tgccctaccttccagagcccatatcaatgcctgtgtcagagccctggg

SEQ ID NO: 205 - DNA (genomic), 46 bp; double-stranded, linear
  hypothetical: NO
  original source individual isolate: Human germline immunoglobulin kappa light chain V-segment
acttcccttgtgggtctgagataaaagctcagctctaacccttacc

SEQ ID NO: 206 - DNA (genomic), 46 bp; double-stranded, linear
  hypothetical: NO
  original source individual isolate: Human interleukin-2 (IL-2) gene
tatttttccagaattaacagtataaattgcatctcttgttcaagag

SEQ ID NO: 207 - DNA (genomic), 47 bp; double-stranded, linear
  hypothetical: NO
  original source individual isolate: Human gene for interleukin 1 alpha (IL-1 alpha)
ccacgcctacttaagacaattacaaaaggcgaagaagactgactcag

SEQ ID NO: 208 - DNA (genomic), 48 bp; double-stranded, linear
  hypothetical: NO
  original source individual isolate: Human gene for prointerleukin 1 beta
ttgattgtgaaatcaggtattcaacagagaaatttctcagcctcctac

SEQ ID NO: 209 - DNA (genomic), 47 bp; double-stranded, linear
  hypothetical: NO
  original source individual isolate: Human gene for prointerleukin 1 beta
ctacttctgcttttgaaagctataaaaacagcgagggagaaactggc

SEQ ID NO: 210 - DNA (genomic), 48 bp; double-stranded, linear
  hypothetical: NO
  original source individual isolate: human interleukin 2 receptor gene
agaaaggattcataaatgaagttcaatccttctcatcaccccagccca

SEQ ID NO: 211 - DNA (genomic), 46 bp; double-stranded, linear
  hypothetical: NO
  original source individual isolate: Human interleukin 2 receptor gene
tttgaaaaattaccgcaaactatattgtcatcaaaaaaaaaaaaaa

SEQ ID NO: 212 - DNA (genomic), 45 bp; double-stranded, linear
  hypothetical: NO
  original source individual isolate: Human interleukin 4 gene
atctggtgtaacgaaaatttccaatgtaaactcattttccctcgg

SEQ ID NO: 213 - DNA (genomic), 48 bp; double-stranded, linear
  hypothetical: NO
  original source individual isolate: Human interleukin 4 gene
ggtttcagcaattttaaatctatatatagagatatctttgtcagcatt

SEQ ID NO: 214 - DNA (genomic), 50 bp; double-stranded, linear
  hypothetical: NO
  original source individual isolate: Human interleukin 5 (IL-5) gene
catttcctcaaagacagacaataaattgactggggacgcagtcttgtact

SEQ ID NO: 215 - DNA (genomic), 50 bp; double-stranded, linear
  hypothetical: NO
  original source individual isolate: Human interleukin 7 (IL-7) gene
ttgctttgattcaggccagctggtttttctgcggtgattcggaaattcgc

SEQ ID NO: 216 - DNA (genomic), 48 bp; double-stranded, linear
  hypothetical: NO
  original source individual isolate: Human interleukin 9 gene (IL-9)
ttccgtgtttgagagggagctttaaataccactcgatttgaaggtgtc

SEQ ID NO: 217 - DNA (genomic), 45 bp; double-stranded, linear
  hypothetical: NO
  original source individual isolate: Human int-1 mammary oncogene
acttcagccagcgccgcaactataagaggcggtgccgcccgccgt

SEQ ID NO: 218 - DNA (genomic), 46 bp; double-stranded, linear
  hypothetical: NO
  original source individual isolate: Human jun-B gene
tccgtggctgactagcgcggtataaaggcgtgtggctcaggctgag

SEQ ID NO: 219 - DNA (genomic), 46 bp; double-stranded, linear
  hypothetical: NO
  original source individual isolate: Human DNA for 65 kD keratin type II
gcccaacaacctcctcaaatgtatataaagggatttttattgcaca

SEQ ID NO: 220 - DNA (genomic), 46 bp; double-stranded, linear
  hypothetical: NO
  original source individual isolate: Human ultra high-sulphur keratin protein gene
tggtgtgttcctatgtgggatataaagagccggggctcagggggct

SEQ ID NO: 221 - DNA (genomic), 47 bp; double-stranded, linear
  hypothetical: NO
  original source individual isolate: Human alpha-lactalbumin gene
cctgaggctttctgcatgaatataaataaatgaaactgagtgatgct

SEQ ID NO: 222 - DNA (genomic), 45 bp; double-stranded, linear
  hypothetical: NO
  original source individual isolate: Human LAG-1 gene
gtcctaggcctcagagtccctataagagagattcccaactcagta

SEQ ID NO: 223 - DNA (genomic), 48 bp; double-stranded, linear
  hypothetical: NO
  original source individual isolate: Human lecithin-cholesterol acyltransferase (LCAT) gene
ctgaggctgtgcccctttccggcaatctctggccacaacccccactgg

SEQ ID NO: 224 - DNA (genomic), 45 bp; double-stranded, linear
  hypothetical: NO
  original source individual isolate: Human lecthin-cholesterol acyltransferase (LCAT) gene
cccctcccactcccacaccagataaggacagcccagtgccgcttt

SEQ ID NO: 225 - DNA (genomic), 50 bp; double-stranded, linear
  hypothetical: NO
  original source individual isolate: Human lymphocyte-specific protein kinase (lck) gene
gggagcagatcttgggggagccccttcagccccctcttccattccctcag

SEQ ID NO: 226 - DNA (genomic), 48 bp; double-stranded, linear
  hypothetical: NO
  original source individual isolate: Human leukocyte fuction-associated antigen-1 (LFA-1) gene
gggtatctcactgtggtttgatttgcatttctctaatgactaatagtg

SEQ ID NO: 227 - DNA (genomic), 46 bp; double-stranded, linear
  hypothetical: NO
  original source individual isolate: Human leukocyte fuction-associated antigen-1 (LFA-1) gene
atgtctctaacttgcttacacttcctccctgaaccctgcggtttca

SEQ ID NO: 228 - DNA (genomic), 48 bp; double-stranded, linear
  hypothetical: NO
  original source individual isolate: Human leukocyte function-associated antigen-1 (LFA-1) gene
tcctgcaggcacacctccctccccgcctgccagtgtcaccagcctgtt

SEQ ID NO: 229 - DNA (genomic), 50 bp; double-stranded, linear
  hypothetical: NO
  original source individual isolate: Human leukocyte function-associated antigen-1
ctgttgcctctgtgagaaagtaccactgtaagaggccaaagggcatgatc

SEQ ID NO: 230 - DNA (genomic), 47 bp; double-stranded, linear
  hypothetical: NO
  original source individual isolate: human lipoprotein lipase (LPL) gene
tatttgcatatttccagtcacataagcagccttggcgtgaaaacagt

SEQ ID NO: 231 - DNA (genomic), 50 bp; double-stranded, linear
  hypothetical: NO
  original source individual isolate: Human leukocyte adhesion molecule-1 (LAM-1)
tgggttagagaaatgaaagaaagcaaggctttctgttgacattcagtgca

SEQ ID NO: 232 - DNA (genomic), 46 bp; double-stranded, linear
  hypothetical: NO
  original source individual isolate: Human lysozyme gene
agaaggaagttaaaagatgttaaatactggggccagctcaccctgg

SEQ ID NO: 233 - DNA (genomic), 46 bp; double-stranded, linear
  hypothetical: NO
  original source individual isolate: Human mannose binding protein 1 (MBP1) gene
agggatgggtcatctatttctatatagcctgcacccagattgtagg

SEQ ID NO: 234 - DNA (genomic), 46 bp; double-stranded, linear
  hypothetical: NO
  original source individual isolate: Human mast cell carboxypeptidase A (MC-CPA) gene
catcaagataagggctgaggcataaaactgccagagggtctcaagg

SEQ ID NO: 235 - DNA (genomic), 45 bp; double-stranded, linear
  hypothetical: NO
  original source individual isolate: Human P-glycoprotein (MDR1) gene
ctttgccacaggaagcctgagctcattcgagtagcggctcttcca

SEQ ID NO: 236 - DNA (genomic), 45 bp; double-stranded, linear
  hypothetical: NO
  original source individual isolate: Human bone marrow serine protease gene (medullasin)
acggcctcccagcacagggctataagaggagccgggcgggcacgg

SEQ ID NO: 237 - DNA (genomic), 47 bp; double-stranded, linear
  hypothetical: NO
  original source individual isolate: Human microsomal epoxide hydrolase gene
ttgctgtgcagagtccaggggagataaccacgctgtgcacacatgag

SEQ ID NO: 238 - DNA (genomic), 52 bp; double-stranded, linear
  hypothetical: NO
  original source individual isolate: Human metallothionein-Ie gene
gcagccagttgcagggctccattctgctttccaactgcctgactgcttgttc

SEQ ID NO: 239 - DNA (genomic), 46 bp; double-stranded, linear
  hypothetical: NO
  original source individual isolate: Human myoglobin gene
ttgtcaagcatcccagaaggtataaaaacgcccttgggaccaggca

SEQ ID NO: 240 - DNA (genomic), 47 bp; double-stranded, linear
  hypothetical: NO
  original source individual isolate: Human melanoma growth stimulatory activity (MGSA) gene
gctttccagccccaaccatgcataaaaggggttcgcggatctcggag

SEQ ID NO: 241 - DNA (genomic), 46 bp; double-stranded, linear
  hypothetical: NO
  original source individual isolate: Human alpha-MHC gene for myosin heavy chain (N-terminus)
agagggtgggggaaacgggatataaaggaactggagctttgaggag

SEQ ID NO: 242 - DNA (genomic), 45 bp; double-stranded, linear
  hypothetical: NO
  original source individual isolate: Human class II invariant gamma-chain gene
gattcctctccagcaccgactttaagaggcgagccggggggtcag

SEQ ID NO: 243 - DNA (genomic), 41 bp; double-stranded, linear
  hypothetical: NO
  original source individual isolate: Human motilin gene
cccagggttgggaggtatataagaacccgtcagatcagccg

SEQ ID NO: 244 - DNA (genomic), 50 bp; double-stranded, linear
  hypothetical: NO
  original source individual isolate: Human myeloperoxidase gene
ccacccccagcttagaggacataaaagcgcagattgagctaagaggagct

SEQ ID NO: 245 - DNA (genomic), 49 bp; double-stranded, linear
  hypothetical: NO
  original source individual isolate: Human mitochondrial RNA-processing endoribonuclease RNA gene
aaacacaatttctttagggctataaaatactactctgtgaagctgagga

SEQ ID NO: 246 - DNA (genomic), 47 bp; double-stranded, linear
  hypothetical: NO
  original source individual isolate: Human myc-oncogene
gagggagggatcgcgctgagtataaaagccggttttcggggctttat

SEQ ID NO: 247 - DNA (genomic), 46 bp; double-stranded, linear
  hypothetical: NO
  original source individual isolate: Human Na,K-ATPase beta subunit (ATP1B) gene
gcacggccgccggggcgcggtatatagtaaaggtagggcgggcgca

SEQ ID NO: 248 - DNA (genomic), 44 bp; double-stranded, linear
  hypothetical: NO
  original source individual isolate: Human neuromedin K receptor
gaagcgtgggaccccatgagtataaagagagcctgtagcgcagg

SEQ ID NO: 249 - DNA (genomic), 46 bp; double-stranded, linear
  hypothetical: NO
  original source individual isolate: Human gene for heavy neurofiliment subunit (NF-H) gene
ttggacccggccgcggcggctataaaagggccggcgccctggtcgt

SEQ ID NO: 250 - DNA (genomic), 47 bp; double-stranded, linear
  hypothetical: NO
  original source individual isolate: Human nuclear factor NF-IL6 gene
cggttgctacgggccgcccttataaataaccgggctcaggagaaact

SEQ ID NO: 251 - DNA (genomic), 46 bp; double-stranded, linear
  hypothetical: NO
  original source individual isolate: Human neurofilament subunit NF-L gene
tgcgtcaggacctcccggcgtataaataggggtggcagaacggcgc

SEQ ID NO: 252 - DNA (genomic), 48 bp; double-stranded, linear
  hypothetical: NO
  original source individual isolate: Human neurokinin-2 receptor (NK-2) gene
tctcttcagcgaaggggttgatttataagggtgttttctgctctgaca

SEQ ID NO: 253 - DNA (genomic), 49 bp; double-stranded, linear
  hypothetical: NO
  original source individual isolate: Human n-myc gene
gggtgtgtcagatttttcagttaataatatcccccgagcttcaaagcgc

SEQ ID NO: 254 - DNA (genomic), 46 bp; double-stranded, linear
  hypothetical: NO
  original source individual isolate: Human ornithine decarboxylase (ODC1) gene
ccatggcgacccgccggtgctataagtagggagcggcgtgccgtgg

SEQ ID NO: 255 - DNA (genomic), 46 bp; double-stranded, linear
  hypothetical: NO
  original source individual isolate: Human ornithine transcarbamylase (OTC) gene
atacacagcggtggagcttggcataaagttcaaatgctcctacacc

SEQ ID NO: 256 - DNA (genomic), 50 bp; double-stranded, linear
  hypothetical: NO
  original source individual isolate: Human prepro-oxytocin-neurophysin I gene
ctccaccgacgcaatgcccaggcataaaaaggccaggccgagagaccgcc

SEQ ID NO: 257 - DNA (genomic), 45 bp; double-stranded, linear
  hypothetical: NO
  original source individual isolate: Human cytochrome P450scc gene
tatggccttgagctggtagttataatcttggccctggtggcccag

SEQ ID NO: 258 - DNA (genomic), 50 bp; double-stranded, linear
  hypothetical: NO
  original source individual isolate: Human p53 gene for transmembrane related p53
cccctcccatgtgctcaagactggcgctaaaagttttgagcttctcaaaa

SEQ ID NO: 259 - DNA (genomic), 47 bp; double-stranded, linear; identical to SEQ ID NO: 38
  hypothetical: NO
  original source individual isolate: Human Alzheimer's disease amyloid A4 precursor gene

SEQ ID NO: 260 - DNA (genomic), 54 bp; double-stranded, linear; identical to SEQ ID NO: 39
  hypothetical: NO
  original source individual isolate: Human Alzheimer's disease amyloid A4 precursor gene

SEQ ID NO: 261 - DNA (genomic), 48 bp; double-stranded, linear
  hypothetical: NO
  original source individual isolate: Human Alzheimer's disease amyloid A4 precursor
gcggggtgggccggatcagctgactcgcctggctctgagccccgccgc

SEQ ID NO: 262 - DNA (genomic), 49 bp; double-stranded, linear
  hypothetical: NO
  original source individual isolate: Human Alzheimer's disease amyloid A4 precursor gene
ccgccgccgcgctcgggctccgtcagtttcctcggcagcggtaggcgag

SEQ ID NO: 263 - DNA (genomic), 47 bp; double-stranded, linear
  hypothetical: NO
  original source individual isolate: Human gene for plasminogen activator inhibitor 1 (PAI-1)
tatttcctgcccacatctggtataaaaggaggcagtggcccacagag

SEQ ID NO: 264 - DNA (genomic), 45 bp; double-stranded, linear
  hypothetical: NO
  original source individual isolate: Human platelet-derived growth factor A-chain (PDGF) gene
aggggcgcggcggcggcggctataaccctctccccgccgccggcc

SEQ ID NO: 265 - DNA (genomic), 46 bp; double-stranded, linear
  hypothetical: NO
  original source individual isolate: Human PGP9.5 gene for neuron-specific ubiquitin
acagtgcgtctggccggcgctttatagctgcagcctggcgctccgc

SEQ ID NO: 266 - DNA (genomic), 50 bp; double-stranded, linear; identical to SEQ ID NO: 256
  hypothetical: NO
  original source individual isolate: Human plasminogen gene

SEQ ID NO: 267 - DNA (genomic), 49 bp; double-stranded, linear
  hypothetical: NO
  original source individual isolate: Human phenylethanolamine N-methylase (PNMT) gene
tcggggcgggggtcgggcggtagaaaaaagggccgcgaggcgagcgggg

SEQ ID NO: 268 - DNA (genomic), 47 bp; double-stranded, linear
  hypothetical: NO
  original source individual isolate: Human opiomelanocortin gene
ctccccgtgtgcagacggtgatatttaccgccaaatgcgaaccaggc

SEQ ID NO: 269 - DNA (genomic), 46 bp; double-stranded, linear
  hypothetical: NO
  original source individual isolate: Human gene PRB3L for proline-rich protein G1
gccactgttctgctcctctttataaagggagctgccatggttctcc

SEQ ID NO: 270 - DNA (genomic), 44 bp; double-stranded, linear
  hypothetical: NO
  original source individual isolate: Human PRB4 gene for proline-rich protein Po
cattgttttgctcctctttataaagggagttgccacgttcctcc

SEQ ID NO: 271 - DNA (genomic), 46 bp; double-stranded, linear
  hypothetical: NO
  original source individual isolate: Human prolactin gene
aggctttgatatcaaaggtttataaagccaatatctgggaaagaga

SEQ ID NO: 272 - DNA (genomic), 46 bp; double-stranded, linear
  hypothetical: NO
  original source individual isolate: Human prothymosin-alpha gene
ccgagcgccgcccactaatctatattaaagcttctggcgccgcgtg

SEQ ID NO: 273 - DNA (genomic), 46 bp; double-stranded, linear
  hypothetical: NO
  original source individual isolate: Human protamine 2 gene
tcatagtgggcgtccccctttatatacaagctcccggggagccttg

SEQ ID NO: 274 - DNA (genomic), 46 bp; double-stranded, linear
  hypothetical: NO
  original source individual isolate: Human SPR2-1 gene for small proline rich protein
ctgggtggggtagcaggctctataaagagatcctctgctgcacgac

SEQ ID NO: 275 - DNA (genomic), 47 bp; double-stranded, linear
  hypothetical: NO
  original source individual isolate: Human estrogen-responsive gene pS2
taagcaaacagagcctgccctataaaatccggggctcgggcggcctc

SEQ ID NO: 276 - DNA (genomic), 46 bp; double-stranded, linear
  hypothetical: NO
  original source individual isolate: Human pulmonary surfactant apoprotein (PSAP) gene
agcctggcagcccccacatctataaatgctgcgtctaccttaccct

SEQ ID NO: 277 - DNA (genomic), 45 bp; double-stranded, linear
  hypothetical: NO
  original source individual isolate: Human gene for prostatic secretory protein PSP-94
tgcgtggttgccctctccagtataaaagtttgatgcagcttttcc

SEQ ID NO: 278 - DNA (genomic), 49 bp; double-stranded, linear
  hypothetical: NO
  original source individual isolate: Human parathyroid hormone-related peptide (PTHRP) gene
gaggtagacagacagctatgtatatatatgtgggtttcgctacaagtgg

SEQ ID NO: 279 - DNA (genomic), 46 bp; double-stranded, linear
  hypothetical: NO
  original source individual isolate: Human gene for purine nucleoside phosphorylase
ctggggactccagggcaagggatataagccagagcctagaccagtg

SEQ ID NO: 280 - DNA (genomic), 20 bp; double-stranded, linear
  hypothetical: NO
  original source individual isolate: Human rDNA
attttgggccgccgggttat

SEQ ID NO: 281 - DNA (genomic), 46 bp; double-stranded, linear
  hypothetical: NO
  original source individual isolate: Human regenerating protein (reg) gene
gttcttatctcagatcctgatataaagctcctacagctacctggcc

SEQ ID NO: 282 - DNA (genomic), 47 bp; double-stranded, linear
  hypothetical: NO
  original source individual isolate: Human renin gene
atcaccccatgcatggagtgtataaaaggggaagggctaagggagcc

SEQ ID NO: 283 - DNA (genomic), 46 bp; double-stranded, linear
  hypothetical: NO
  original source individual isolate: Human gene fragment for retinol binding protein (RBP)
cgaccccctccccccggcgctataaagcagcggggcggccgcggcg

SEQ ID NO: 284 - DNA (genomic), 48 bp; double-stranded, linear
  hypothetical: NO
  original source individual isolate: Human serum amyloid A (GSAA1) gene
caccccgctaatttaaaaaatatatatacagatatatagtggagatgg

SEQ ID NO: 285 - DNA (genomic), 47 bp; double-stranded, linear
  hypothetical: NO
  original source individual isolate: Human SAA1 beta gene
aaccagcagggaaggctcagtataaatagcagccaccgctccctggc

SEQ ID NO: 286 - DNA (genomic), 48 bp; double-stranded, linear
  hypothetical: NO
  original source individual isolate: Human gene fragment for HLA class II SB 4-beta chain
ctacttgggttcatggtctctaatatttcaaacaggagctccctttag

SEQ ID NO: 287 - DNA (genomic), 46 bp; double-stranded, linear
  hypothetical: NO
  original source individual isolate: Human c-sis proto-oncogene
tcgcactctcccttctcctttataaaggccggaacagctgaaaggg

SEQ ID NO: 288 - DNA (genomic), 46 bp; double-stranded, linear
  hypothetical: NO
  original source individual isolate: Human SLPI gene for secretory leukocyte protease inhibitor
cacacccactggtgaaagaataaatagtgaggtttggcattggcca

SEQ ID NO: 289 - DNA (genomic), 46 bp; double-stranded, linear
  hypothetical: NO
  original source individual isolate: Human superoxide dismutase (SOD-1) gene
cgaggcgcggaggtctggcctataaagtagtcgcggagacggggtg

SEQ ID NO: 290 - DNA (genomic), 45 bp; double-stranded, linear
  hypothetical: NO
  original source individual isolate: Human ornithine decarboxylase gene
tccatggcgacccgccggtgctataagtagggagcggcgtgccgt

SEQ ID NO: 291 - DNA (genomic), 45 bp; double-stranded, linear
  hypothetical: NO
  original source individual isolate: Human steroid 5-alpha-reductase gene
ctgcccccgcgccgccgccctatatgttgcccgccgcggcctctg

SEQ ID NO: 292 - DNA (genomic), 44 bp; double-stranded, linear
  hypothetical: NO
  original source individual isolate: Human substance P receptor gene
gtgacgtctctgcagggggttataaaagcctcgtgcgcagctaa

SEQ ID NO: 293 - DNA (genomic), 46 bp; double-stranded, linear
  hypothetical: NO
  original source individual isolate: Human synaptobrevin 1 (SYB1) gene
ccgggaggcgtggtcagcactaataaaggcggaggccggcgcggca

SEQ ID NO: 294 - DNA (genomic), 47 bp; double-stranded, linear
  hypothetical: NO
  original source individual isolate: Human tyrosine aminotransferase (TAT) gene
caacgcccatttgtggagactatttcaggagttaggatttgcatctg

SEQ ID NO: 295 - DNA (genomic), 47 bp; double-stranded, linear
  hypothetical: NO
  original source individual isolate: Human T-cell receptor V-beta gene
gacagatgcattctgtggggataaaatgtcacaaaattcatttcttt

SEQ ID NO: 296 - DNA (genomic), 45 bp; double-stranded, linear
  hypothetical: NO
  original source individual isolate: Human T-cell receptor V-beta gene
tcacagagggcctggtctagaatattccacatctgctctcactct

SEQ ID NO: 297 - DNA (genomic), 47 bp; double-stranded, linear; identical to SEQ ID NO: 295
  hypothetical: NO
  original source individual isolate: Human T-cell receptor V-beta gene

SEQ ID NO: 298 - DNA (genomic), 46 bp; double-stranded, linear
  hypothetical: NO
  original source individual isolate: Human T-cell receptor V-beta gene
tcacagagggcctggtctggaatattccacatctgctctcactctg

SEQ ID NO: 299 - DNA (genomic), 45 bp; double-stranded, linear
  hypothetical: NO
  original source individual isolate: Human T-cell receptor V-beta chain gene
tgttactgtaggaactaccgtataaggacaggatgtcccacctcc

SEQ ID NO: 300 - DNA (genomic), 45 bp; double-stranded, linear
  hypothetical: NO
  original source individual isolate: Human transferrin (Tf) gene
ccgcccaggccgggaatggaataaagggacgcggggcgccggagg

SEQ ID NO: 301 - DNA (genomic), 10 bp; double-stranded, linear
  hypothetical: NO
  original source individual isolate: Human interleukin 3 gene
gggcaccttg

SEQ ID NO: 302 - DNA (genomic), 50 bp; double-stranded, linear
  hypothetical: NO
  original source individual isolate: Human tissue factor gene
cgggagagcgcgccgccggccctttatagcgcgcggggcaccggctcccc

SEQ ID NO: 303 - DNA (genomic), 47 bp; double-stranded, linear
  hypothetical: NO
  original source individual isolate: Human transforming growth factor-beta (TGF-beta)
tgccttgcccatgggggctgtatttaaggacaccgtgccccaagccc

SEQ ID NO: 304 - DNA (genomic), 47 bp; double-stranded, linear
  hypothetical: NO
  original source individual isolate: Human transforming growth factor beta-3 gene
gagacgtcatgggagggaggtataaaatttcagcagagagaaataga

SEQ ID NO: 305 - DNA (genomic), 45 bp; double-stranded, linear
  hypothetical: NO
  original source individual isolate: Human transforming growth factor beta-2 gene
cacgtggttcagagagaacttataaatctcccctccccgcgaaga

SEQ ID NO: 306 - DNA (genomic), 46 bp; double-stranded, linear
  hypothetical: NO
  original source individual isolate: Human tyrosine hydroxylase (TH) gene
ggctttgacgtcagctcagcttataagaggctgctgggccagggct

SEQ ID NO: 307 - DNA (genomic), 46 bp; double-stranded, linear
  hypothetical: NO
  original source individual isolate: Human metallothionein gene IIA
tcgtcccggctctttctagctataaacactgcttgccgcgctgcac

SEQ ID NO: 308 - DNA (genomic), 46 bp; double-stranded, linear
  hypothetical: NO
  original source individual isolate: Human thrombospondin gene
cccaggaatgcgagcgcccctttaaaagcgcgcggctcctccgcct

SEQ ID NO: 309 - DNA (genomic), 45 bp; double-stranded, linear
  hypothetical: NO
  original source individual isolate: Human thyroxine-binding globulin gene
ataatgttgctataacatctgaatgacagtccatggcattatttc

SEQ ID NO: 310 - DNA (genomic), 47 bp; double-stranded, linear
  hypothetical: NO
  original source individual isolate: Human thyroglobulin gene
gaaagtgccaacggcagctctataaaagctccctggccaggggacct

SEQ ID NO: 311 - DNA (genomic), 46 bp; double-stranded, linear
  hypothetical: NO
  original source individual isolate: Human gene for tumor necrosis factor (TNF-alpha)
ctcctctcgccccagggacatataaaggcagttgttggcacaccca

SEQ ID NO: 312 - DNA (genomic), 46 bp; double-stranded, linear
  hypothetical: NO
  original source individual isolate: Human lymphotoxin (TNF-beta) gene
gctgccactgccgcttcctctataaagggacctgagcgtccgggcc

SEQ ID NO: 313 - DNA (genomic), 50 bp; double-stranded, linear
  hypothetical: NO
  original source individual isolate: Human type I DNA topoisomerase gene
tgacgtcgccgacgtgttgtttaaaagcggccgcgcaggcgcagtgagcc

SEQ ID NO: 314 - DNA (genomic), 47 bp; double-stranded, linear
  hypothetical: NO
  original source individual isolate: Human triosephosphate isomerase (TPI) gene
agttccacttcgcggcgctctatataagtgggcagtggccggactgc

SEQ ID NO: 315 - DNA (genomic), 44 bp; double-stranded, linear
  hypothetical: NO
  original source individual isolate: Human thyroid peroxidase gene
atccaagcgcagagtcagtttataaggtgggtaaccaagtccct

SEQ ID NO: 316 - DNA (genomic), 46 bp; double-stranded, linear
  hypothetical: NO
  original source individual isolate: Human transferrin receptor gene
ggccgggggcggggccaggctataaaccgccggttaggggccgcca

SEQ ID NO: 317 - DNA (genomic), 50 bp; double-stranded, linear
  hypothetical: NO
  original source individual isolate: Human tryptase -I gene
cgccccctcctgatctggaaggataaatggggaggggagagccactgggt

SEQ ID NO: 318 - DNA (genomic), 46 bp; double-stranded, linear
  hypothetical: NO
  original source individual isolate: Human beta 2 gene for beta-tubulin
gcggaggcgggcagggagggtatataagcgttggcggacggtcggt

SEQ ID NO: 319 - DNA (genomic), 46 bp; double-stranded, linear
  hypothetical: NO
  original source individual isolate: Human gene for U 6 RNA
gtatttcgatttcttggctttatatatcttgtggaaaggacgaaac

SEQ ID NO: 320 - DNA (genomic), 47 bp; double-stranded, linear
  hypothetical: NO
  original source individual isolate: Human uPA gene for urokinase-plasminogen activator
ggcggcgccggggcgggccctgatatagagcaggcgccgcgggtcgc

SEQ ID NO: 321 - DNA (genomic), 36 bp; double-stranded, linear
  hypothetical: NO
  original source individual isolate: Human proto-oncogene vav
gcaggcgtgcgggcgggtgggtggtggaggctgcga

SEQ ID NO: 322 - DNA (genomic), 45 bp; double-stranded, linear
  hypothetical: NO
  original source individual isolate: Human vascular cell adhesion molecule-1 (VCAM1) gene
gcctctgcaacaagaccctttataaagcacagactttctatttca

SEQ ID NO: 323 - DNA (genomic), 45 bp; double-stranded, linear
  hypothetical: NO
  original source individual isolate: Human vimentin gene
accctctttcctaacggggttataaaaacagcgccctcggcgggg

SEQ ID NO: 324 - DNA (genomic), 50 bp; double-stranded, linear
  hypothetical: NO
  original source individual isolate: Human U1 RNA gene
gtaaagggtgaggtatatggagctgtgacagggcagaagtgtgtgaagtc

SEQ ID NO: 325 - DNA (genomic), 50 bp; double-stranded, linear
  hypothetical: NO
  original source individual isolate: Human gene for small nuclear U1 RNA
gtaaagagtgaggcgtatgaggctgtgtcggggcagaggcccaagatctc

SEQ ID NO: 326 - DNA (genomic), 50 bp; double-stranded, linear
  hypothetical: NO
  original source individual isolate: Human small nuclear U2 RNA gene
ttgaatgtggatgagagtgggacggtgacggcgggcgcgaaggcgagcgc

SEQ ID NO: 327 - DNA (genomic), 50 bp; double-stranded, linear
  hypothetical: NO
  original source individual isolate: Human U3 small nuclear RNA gene
aaaagtttgcggcagatgtagacctagcagaggtgtgcgaggaggccgtt

SEQ ID NO: 328 - DNA (genomic), 50 bp; double-stranded, linear
  hypothetical: NO
  original source individual isolate: Human U4C small nuclear RNA gene
aaatggtagtcatcatccgtgggggagcggggcgcgaataaagcctttcc

SEQ ID NO: 329 - DNA (genomic), 50 bp; double-stranded, linear
  hypothetical: NO
  original source individual isolate: Human histone H3.3 gene
gggcggggcggcgtgtgttgggggatagcctcggtgtcagccatctttca

SEQ ID NO: 330 - DNA (genomic), 50 bp; double-stranded, linear
  hypothetical: NO
  original source individual isolate: Human histone H4 gene
agttcggtccgccaactgtcgtataaaggcgctgcctcaggtcagaggcc

SEQ ID NO: 331 - DNA (genomic), 50 bp; double-stranded, linear
  hypothetical: NO
  original source individual isolate: Human non-histone chromosomal protein HMG-14 gene
tggggggcggcccggccggcggggagggggagccgcggccgggacgcggg

SEQ ID NO: 332 - DNA (genomic), 50 bp; double-stranded, linear
  hypothetical: NO
  original source individual isolate: Human ribosomal protein S14 gene
aagtaataaaccgtctttccttatgacgagtcttaaactctttgggagga

SEQ ID NO: 333 - DNA (genomic), 50 bp; double-stranded, linear
  hypothetical: NO
  original source individual isolate: Human gene for alpha tubulin (b alpha 1)
cgcgaccgagggtctgggcgtcccggctgggccccgtgtctgtgcgcacg

SEQ ID NO: 334 - DNA (genomic), 50 bp; double-stranded, linear
  hypothetical: NO
  original source individual isolate: Human skeletal alpha-actin gene
agggaatcgcccgcgggctatataaaacctgagcagagggacaagcggcc

SEQ ID NO: 335 - DNA (genomic), 50 bp; double-stranded, linear
  hypothetical: NO
  original source individual isolate: Human epidermal 67-kDa Keratin gene
ggaagatcttgtgtgataaaacaattaccacatgaaccaatcttgcatgc

SEQ ID NO: 336 - DNA (genomic), 50 bp; double-stranded, linear
  hypothetical: NO
  original source individual isolate: Human 50 KDatype I epidermal keratin gene
gacccgccccctacccatgagtataaagcactcgcatccctttgcaattt

SEQ ID NO: 337 - DNA (genomic), 50 bp; double-stranded, linear
  hypothetical: NO
  original source individual isolate: Human alpha-1 collagen type I gene
ctgctctccatcaggacagtataaaaggggcccgggccagtcgtcggagc

SEQ ID NO: 338 - DNA (genomic), 50 bp; double-stranded, linear
  hypothetical: NO
  original source individual isolate: Human collagen type-III gene
gtgagggaagccaaactttttcctatttaaggccaaagcaaaggaatctc

SEQ ID NO: 339 - DNA (genomic), 50 bp; double-stranded, linear
  hypothetical: NO
  original source individual isolate: Human pro-alpha-2 (I) mRNA for collagen N-prepropeptide
cagggaaacttttgccgtataaatagggcagatccgggatttgttatttt

SEQ ID NO: 340 - DNA (genomic), 50 bp; double-stranded, linear
  hypothetical: NO
  original source individual isolate: Human fibronectin (FN) gene
tccagaggggcgggagggccgtcccatataagcccggctcccgcgctccg

SEQ ID NO: 341 - DNA (genomic), 50 bp; double-stranded, linear
  hypothetical: NO
  original source individual isolate: Human von Willebrand factor gene
tgtttccttttggtaattaaaaggaggccaatcccctgttgtggcagctc

SEQ ID NO: 342 - DNA (genomic), 45 bp; double-stranded, linear; identical to SEQ ID NO: 130
  hypothetical: NO
  original source individual isolate: Human gene for fibrinogen gamma chain

SEQ ID NO: 343 - DNA (genomic), 50 bp; double-stranded, linear
  hypothetical: NO
  original source individual isolate: Human gene for fibrinogen gamma chain
cagtcctggctatcccaggagcttacataaagggacaattggagcctgag

SEQ ID NO: 344 - DNA (genomic), 50 bp; double-stranded, linear
  hypothetical: NO
  original source individual isolate: Human involucrin mRNA
aggccaggctgcagaatgatataaagagtgccctgactcctgctcagctc

SEQ ID NO: 345 - DNA (genomic), 50 bp; double-stranded, linear
  hypothetical: NO
  original source individual isolate: Human apolipoprotein A-I and C-III genes
ccagaccctggctgcagacataaataggccctgcaagagctggctgctta

SEQ ID NO: 346 - DNA (genomic), 50 bp; double-stranded, linear
  hypothetical: NO
  original source individual isolate: Human apolipoprotein B-100 (apoB) gene
gctcttgcagcctgggcttcctataaatggggtgcgggcgccggccgcgc

SEQ ID NO: 347 - DNA (genomic), 20 bp; double-stranded, linear
  hypothetical: NO
  original source individual isolate: Human apolipoprotein A-I and C-III genes
tctagggatgaactgagcag

SEQ ID NO: 348 - DNA (genomic), 51 bp; double-stranded, linear
  hypothetical: NO
  original source individual isolate: Humanapolipoprotein A-I and C-III genes
acaggcaggagggttctgacctgttttatatcatctccagggcagcaggca

SEQ ID NO: 349 - DNA (genomic), 50 bp; double-stranded, linear
  hypothetical: NO
  original source individual isolate: Human albumin gene
tacaattattggttaaagaagtatattagtgctaatttccctccgtttgt

SEQ ID NO: 350 - DNA (genomic), 51 bp; double-stranded, linear
  hypothetical: NO
  original source individual isolate: Human albumin gene
tacaattattggttaaagaagtatattagtgctaatttccctccgtttgtc

SEQ ID NO: 351 - DNA (genomic), 50 bp; double-stranded, linear
  hypothetical: NO
  original source individual isolate: Human serum prealbumin gene
cctagctcaggagaagtgagtataaaagccccaggctgggagcagccatc

SEQ ID NO: 352 - DNA (genomic), 50 bp; double-stranded, linear; identical to SEQ ID NO: 20
  hypothetical: NO
  original source individual isolate: Human alpha-fetoprotein (AFP) gene

SEQ ID NO: 353 - DNA (genomic), 41 bp; double-stranded, linear
  hypothetical: NO
  original source individual isolate: Human C-reactive protein gene
aggcaggaggaggtagctctaaggcaagagatctgggactt

SEQ ID NO: 354 - DNA (genomic), 50 bp; double-stranded, linear
  hypothetical: NO
  original source individual isolate: Human gene A for alpha 1-acid glycoprotein
aagtgaccgcccatagtttattataaaggtgactgcaccctgcagccacc

SEQ ID NO: 355 - DNA (genomic), 51 bp; double-stranded, linear
  hypothetical: NO
  original source individual isolate: Human gene A for alpha 1-acid glycoprotein
aagtgaccgcccatagtttattataaaggtgactgcaccctgcagccacca

SEQ ID NO: 356 - DNA (genomic), 40 bp; double-stranded, linear
  hypothetical: NO
  original source individual isolate: Human gene for L apoferritin
cggcgcaccataaaagaagccgccctagccacgtcccctc

SEQ ID NO: 357 - DNA (genomic), 41 bp; double-stranded, linear
  hypothetical: NO
  original source individual isolate: Human gene for L apoferritin
cggcgcaccataaaagaagccgccctagccacgtcccctcg

SEQ ID NO: 358 - DNA (genomic), 50 bp; double-stranded, linear
  hypothetical: NO
  original source individual isolate: Olive baboon alpha-1 globin gene
ggcgtgcccccgcgcccggagcataaaccctggcgcgctcgcggcccggc

SEQ ID NO: 359 - DNA (genomic), 51 bp; double-stranded, linear
  hypothetical: NO
  original source individual isolate: Olive baboon alpha-1 globin gene
ggcgtgcccccgcgcccggagcataaaccctggcgcgctcgcggcccggca

SEQ ID NO: 360 - DNA (genomic), 50 bp; double-stranded, linear
  hypothetical: NO
  original source individual isolate: Human alpha-globin germ line gene
gtgccaacaatggaggtgtttacctgtctcagaccaaggacctctctgca

SEQ ID NO: 361 - DNA (genomic), 50 bp; double-stranded, linear
  hypothetical: NO
  original source individual isolate: Chimpanzee gene for alpha-like zeta-1-globin
cctggctgggcccagctccctgtatataaggggaccctgggggctgagca

SEQ ID NO: 362 - DNA (genomic), 51 bp; double-stranded, linear
  hypothetical: NO
  original source individual isolate: Chimpanzee gene for alpha-like zeta-1-globin
cctggctgggcccagctccctgtatataaggggaccctgggggctgagcac

SEQ ID NO: 363 - DNA (genomic), 50 bp; double-stranded, linear
  hypothetical: NO
  original source individual isolate: Human alpha globin gene cluster on chromosome 16: zeta gene
ctggctgggcccagctccctgtatataaggggaccctgggggctgagcac

SEQ ID NO: 364 - DNA (genomic), 50 bp; double-stranded, linear
  hypothetical: NO
  original source individual isolate: Human theta 1-globin gene
ccgcgggacccctggccggtccgcgcaggcgcagcggggtcgcagggcgc

SEQ ID NO: 365 - DNA (genomic), 50 bp; double-stranded, linear
  hypothetical: NO
  original source individual isolate: Macaque cynomolgus beta-globin gene
gcaggagccagggctgggcataaaagtcagggcagagccatctattgctt

SEQ ID NO: 366 - DNA (genomic), 50 bp; double-stranded, linear
  hypothetical: NO
  original source individual isolate: Chimpanzee beta-globin gene
gcagaagccagggctgggcataaaagtcagggcagagccatctattgctt

SEQ ID NO: 367 - DNA (genomic), 50 bp; double-stranded, linear; identical to SEQ ID NO: 365
  hypothetical: NO
  original source individual isolate: Human germ line gene for beta-globin

SEQ ID NO: 368 - DNA (genomic), 50 bp; double-stranded, linear
  hypothetical: NO
  original source individual isolate: Spider monkey (A.geoffroyi) delta-globin gene
cagggagaacaggaccagcataaaaggcagggcagggctaactgttgctt

SEQ ID NO: 369 - DNA (genomic), 50 bp; double-stranded, linear
  hypothetical: NO
  original source individual isolate: Human transferrin receptor gene
gggcggggccaggctataaaccgccggttaggggccgccatcccctcaga

SEQ ID NO: 370 - DNA (genomic), 50 bp; double-stranded, linear
  hypothetical: NO
  original source individual isolate: Human beta-2-adrenergic receptor gene
agttcccctaaagtcctgtgcacataacgggcagaacgcactgcgaagcg

SEQ ID NO: 371 - DNA (genomic), 50 bp; double-stranded, linear
  hypothetical: NO
  original source individual isolate: Human IgE receptor gene
ggtggcaagcccatatttaggtctatgaaaatagaagctgtcagtggctc

SEQ ID NO: 372 - DNA (genomic), 50 bp; double-stranded, linear
  hypothetical: NO
  original source individual isolate: Human oncogene c-fos
ttcataaaacgcttgttataaaagcagtggctgcggcgcctcgtactcca

SEQ ID NO: 373 - DNA (genomic), 50 bp; double-stranded, linear
  hypothetical: NO
  original source individual isolate: Human c-myc oncogene
aatctccgcccaccggccctttataatgcgagggtctggacggctgagga

SEQ ID NO: 374 - DNA (genomic), 50 bp; double-stranded, linear
  hypothetical: NO
  original source individual isolate: Human B-cell leukemia/lymphoma 2 (bcl-2) proto-oncogene
ccgcccctccgcgccgcctgcccgcccgcccgccgcgctcccgcccgccg

SEQ ID NO: 375 - DNA (genomic), 50 bp; double-stranded, linear
  hypothetical: NO
  original source individual isolate: Human p53 gene
actccatttcctttgcttcctccggcaggcggattacttgcccttacttg

SEQ ID NO: 376 - DNA (genomic), 50 bp; double-stranded, linear
  hypothetical: NO
  original source individual isolate: Human gene homologous to bladder carcinoma oncogene T24
cgcggccctactggctccgcctcccgcgttgctcccggaagccccgcccg

SEQ ID NO: 377 - DNA (genomic), 50 bp; double-stranded, linear
  hypothetical: NO
  original source individual isolate: Human c-abl gene
ggggcgggcctggcgggcgccctctccgggccctttgttaacaggcgcgt

SEQ ID NO: 378 - DNA (genomic), 50 bp; double-stranded, linear
  hypothetical: NO
  original source individual isolate: Human metallothionein-i-a gene
cggccctctttcccctgaccataaaagcagccgctggctgctgggcccta

SEQ ID NO: 379 - DNA (genomic), 50 bp; double-stranded, linear
  hypothetical: NO
  original source individual isolate: Human metallothinonein I-B gene
accccaccacctcccccgactataaaggagcagccagctcctgggctcca

SEQ ID NO: 380 - DNA (genomic), 50 bp; double-stranded, linear
  hypothetical: NO
  original source individual isolate: Human metallothionein-If (MT-IF) gene
cccggccccctcccctgactatcaaagcagcggccggctgtttgggtcca

SEQ ID NO: 381 - DNA (genomic), 50 bp; double-stranded, linear
  hypothetical: NO
  original source individual isolate: Human gene for 27 Kda heat shock protein
ccctcaaacgggtcattgccattaatagagacctcaaacaccgcctgcta

SEQ ID NO: 382 - DNA (genomic), 50 bp; double-stranded, linear
  hypothetical: NO
  original source individual isolate: Human 70 kDa heat shock protein gene
gcgggtctccgtgacgacttataaaaccccaggggcaagcggtccggata

SEQ ID NO: 383 - DNA (genomic), 50 bp; double-stranded, linear
  hypothetical: NO
  original source individual isolate: Human macrophage alpha1-antitrypsin gene
tgcctccacccgaagtctacttcctgggtgggcaggaactgggcactgtg

SEQ ID NO: 384 - DNA (genomic), 50 bp; double-stranded, linear
  hypothetical: NO
  original source individual isolate: Human alpha1-antitrypsin (S variant) gene
cgttgcccctctggatccactgcttaaatacggacgaggacagggccctg

SEQ ID NO: 385 - DNA (genomic), 50 bp; double-stranded, linear
  hypothetical: NO
  original source individual isolate: Human S variable segment 5'of antithrombin III gene
tctgccccaccctgtcctctggaacctctgcgagatttagaggaaagaac

SEQ ID NO: 386 - DNA (genomic), 50 bp; double-stranded, linear
  hypothetical: NO
  original source individual isolate: Human pulmonary surfactant protein (SP5) gene
cccctctccctacggacacatataagaccctggtcacacctgggagagga

SEQ ID NO: 387 - DNA (genomic), 50 bp; double-stranded, linear
  hypothetical: NO
  original source individual isolate: Human Immunoglobulin kappa L-chain V region gene (HK122)
ccccctgccctgaagactttttataggctggtcacacccggagcaggagt

SEQ ID NO: 388 - DNA (genomic), 50 bp; double-stranded, linear
  hypothetical: NO
  original source individual isolate: Human T cell receptor V-alpha/J-alpha chain (rearranged)
ttaaggtttgaatcctcagtgaaccagggcagaaaagaatgatgaaatcc

SEQ ID NO: 389 - DNA (genomic), 50 bp; double-stranded, linear
  hypothetical: NO
  original source individual isolate: Human gene for HLA-DR alpha heavy chain (class II antigen)
tgcattttaatggtcagactctattacaccccacattctcttttctttta

SEQ ID NO: 390 - DNA (genomic), 50 bp; double-stranded, linear
  hypothetical: NO
  original source individual isolate: Human MHC class IIHLA-DC-3-beta gene
ctaccacgcatggaaacatccacagatttttattctttctgccaggtaca

SEQ ID NO: 391 - DNA (genomic), 50 bp; double-stranded, linear
  hypothetical: NO
  original source individual isolate: Human T-cell receptor CD3-gamma gene
gccttctctcaaaggccccagccccaacagtgatgggtggagccagtcta

SEQ ID NO: 392 - DNA (genomic), 50 bp; double-stranded, linear
  hypothetical: NO
  original source individual isolate: Human pregnancy-specific beta-1 glycoprotein mRNA
ctgccctgggaagaggctcagcacagaaagaggaaggacagcacagctga

SEQ ID NO: 393 - DNA (genomic), 50 bp; double-stranded, linear
  hypothetical: NO
  original source individual isolate: Human pregnancy-specific beta-1-glycoprotein 5 (PSG5)
agagaggaggggacagagaggtgtcctgggcctgaccccacccatgagcc

SEQ ID NO: 394 - DNA (genomic), 50 bp; double-stranded, linear
  hypothetical: NO
  original source individual isolate: Human factor VIII gene
cctgtggctgcttcccactgataaaaaggaagcaatcctatcggttactg

SEQ ID NO: 395 - DNA (genomic), 50 bp; double-stranded, linear
  hypothetical: NO
  original source individual isolate: Human ubiquitin gene
tgacgcaacactcgttgcataaatttgcctccgccagcccggagcattta

SEQ ID NO: 396 - DNA (genomic), 50 bp; double-stranded, linear
  hypothetical: NO
  original source individual isolate: Human proliferating cell nucleolar protein P120 gene
actataatacgccaagcgtgcgttctgccgttccctccgacacgcgcgac

SEQ ID NO: 397 - DNA (genomic), 50 bp; double-stranded, linear
  hypothetical: NO
  original source individual isolate: Human gene for delta-globin
cagggaggacaggaccagcataaaaggcagggcagagtcgactgttgctt

SEQ ID NO: 398 - DNA (genomic), 50 bp; double-stranded, linear
  hypothetical: NO
  original source individual isolate: Gorilla fetal A-gamma-globin gene
cggctggctagggatgaagaataaaaggaagcaccctccagcagttccac

SEQ ID NO: 399 - DNA (genomic), 50 bp; double-stranded, linear
  hypothetical: NO
  original source individual isolate: Human gene for fetal A-gamma and G-gamma hemoglobin
cggctggctagggatgaagaataaaaggaagcacccttcagcagttccac

SEQ ID NO: 400 - DNA (genomic), 50 bp; double-stranded, linear
  hypothetical: NO
  original source individual isolate: Orangutan epsilon-globin gene with flanking Alu repeats
cagaacttcggcagtgaagaataaaaggccacacagagaggcagcagcac

SEQ ID NO: 401 - DNA (genomic), 50 bp; double-stranded, linear
  hypothetical: NO
  original source individual isolate: Human haptoglobin (Hp1) gene
taaaaagaccagcagatgccccacagcactgctcttccagaggcaagacc

SEQ ID NO: 402 - DNA (genomic), 71 bp; double-stranded, linear
  hypothetical: NO
  original source individual isolate: Human low molecular weight oligoadenylate synthetase gene
aagacagctcctcccttctgaggaaacgaaaccaacagcagtccaagctcagtcagcagaagagataaaag

SEQ ID NO: 403 - DNA (genomic), 50 bp; double-stranded, linear
  hypothetical: NO
  original source individual isolate: Human gene fragment for dihydrofolate reductase
ggggggcggggcctcgcctgcacaaatagggacgagggggcggggcggcc

SEQ ID NO: 404 - DNA (genomic), 50 bp; double-stranded, linear
  hypothetical: NO
  original source individual isolate: Human thymidine kinase gene
ggctcgtgattggccagcacgccgtggtttaaagcggtcggcgcgggacc

SEQ ID NO: 405 - DNA (genomic), 49 bp; double-stranded, linear
  hypothetical: NO
  original source individual isolate: Human adenosine deaminase gene
gcgggaggcggggcccggcccgttaagaagagcgtggccggccgcggcc

SEQ ID NO: 406 - DNA (genomic), 50 bp; double-stranded, linear
  hypothetical: NO
  original source individual isolate: Human argininosuccinate synthase
tgcccccgggccctgtgcttataacctgggatgggcacccctgccagtcc

SEQ ID NO: 407 - DNA (genomic), 50 bp; double-stranded, linear
  hypothetical: NO
  original source individual isolate: Human ornithine aminotransferase gene
gggggcggggcagaatcagcctttaagttgcagtgacgctccggcgtcac

SEQ ID NO: 408 - DNA (genomic), 45 bp; double-stranded, linear
  hypothetical: NO
  original source individual isolate: Human tyrosine hydroxylase gene
tgacgtcagctcagcttataagaggctgctgggccagggctgtgg

SEQ ID NO: 409 - DNA (genomic), 50 bp; double-stranded, linear
  hypothetical: NO
  original source individual isolate: Human HMG CoA reductase gene
cagctccgagcgtgcgtaaggtgagggctccttccgctccgcgactgcgt

SEQ ID NO: 410 - DNA (genomic), 50 bp; double-stranded, linear
  hypothetical: NO
  original source individual isolate: Human gene for lecithin-cholesterol acyltransferase
cctagggcccctcccactcccacaccagataaggacagcccagtgccgct

SEQ ID NO: 411 - DNA (genomic), 50 bp; double-stranded, linear
  hypothetical: NO
  original source individual isolate: Human porphobilinogen deaminase gene
cgcccagagggagggacctccccttcgagggagggcgccggaagtgacgc

SEQ ID NO: 412 - DNA (genomic), 50 bp; double-stranded, linear
  hypothetical: NO
  original source individual isolate: Human porphobilinogen deaminasegene
gcacagcactcccactgacaactgccttggtcaaggtgggcttcagggct

SEQ ID NO: 413 - DNA (genomic), 50 bp; double-stranded, linear
  hypothetical: NO
  original source individual isolate: Human URO-D gene for uroporphyrinogen decarboxylase
ggggggcaggctcagattcaggttaaattgtggattgagctcgcagttac

SEQ ID NO: 414 - DNA (genomic), 51 bp; double-stranded, linear
  hypothetical: NO
  original source individual isolate: Human URO-D gene for uroporphyrinogen decarboxylase
ggggggcaggctcagattcaggttaaattgtggattgagctcgcagttaca

SEQ ID NO: 415 - DNA (genomic), 50 bp; double-stranded, linear
  hypothetical: NO
  original source individual isolate: Human aldolase B (ALDOB) gene
aaaaaaaaaacatgatgagaagtctataaaaattgtgtgctaccaaagat

SEQ ID NO: 416 - DNA (genomic), 50 bp; double-stranded, linear
  hypothetical: NO
  original source individual isolate: Human aldolase A gene
ggtggcgctgctcaccacacacaagtgttataggaggagtctggcccttg

SEQ ID NO: 417 - DNA (genomic), 51 bp; double-stranded, linear
  hypothetical: NO
  original source individual isolate: Human aldolase A gene
ggtggcgctgctcaccacacacaagtgttataggaggagtctggcccttga

SEQ ID NO: 418 - DNA (genomic), 50 bp; double-stranded, linear
  hypothetical: NO
  original source individual isolate: Human aldolase A gene
tgtggggcgggcaggagctgccttataaccagcccgggaacccctagctc

SEQ ID NO: 419 - DNA (genomic), 51 bp; double-stranded, linear
  hypothetical: NO
  original source individual isolate: Human aldolase A gene
tgtggggcgggcaggagctgccttataaccagcccgggaacccctagctca

SEQ ID NO: 420 - DNA (genomic), 50 bp; double-stranded, linear
  hypothetical: NO
  original source individual isolate: Human aldolase A gene
gctcggcggagggcggagtggtgcctttaaaaggccgggcgccgccttcc

SEQ ID NO: 421 - DNA (genomic), 51 bp; double-stranded, linear
  hypothetical: NO
  original source individual isolate: Human aldolase A gene
gctcggcggagggcggagtggtgcctttaaaaggccgggcgccgccttccg

SEQ ID NO: 422 - DNA (genomic), 50 bp; double-stranded, linear
  hypothetical: NO
  original source individual isolate: Human aldolase A gene
gctaaatcggctgcgttcctctcggaacgcgccgcagaaggggtcctggt

SEQ ID NO: 423 - DNA (genomic), 51 bp; double-stranded, linear
  hypothetical: NO
  original source individual isolate: Human aldolase A gene
gctaaatcggctgcgttcctctcggaacgcgccgcagaaggggtcctggtg

SEQ ID NO: 424 - DNA (genomic), 50 bp; double-stranded, linear
  hypothetical: NO
  original source individual isolate: Human phosphoglycerate kinase gene
gaggcggggtgtggggcggtagtgtgggccctgttcctgcccgcgcggtg

SEQ ID NO: 425 - DNA (genomic), 50 bp; double-stranded, linear
  hypothetical: NO
  original source individual isolate: Human gene for glucose 6-phosphate dehydrogenase gene
caggcgcccgcccccgcccccgccgattaaatgggccggcggggctcagc

SEQ ID NO: 426 - DNA (genomic), 50 bp; double-stranded, linear
  hypothetical: NO
  original source individual isolate: Human hepatic lipase gene
gcagtcttccctaacaaagtatctaataggcattgtggtctctttggctt

SEQ ID NO: 427 - DNA (genomic), 51 bp; double-stranded, linear
  hypothetical: NO
  original source individual isolate: Human hepatic lipase mRNA
gcagtcttccctaacaaagtatctaataggcattgtggtctctttggcttc

SEQ ID NO: 428 - DNA (genomic), 50 bp; double-stranded, linear
  hypothetical: NO
  original source individual isolate: Human protein C gene
agtgctgagggccaagcaaatatttgtggttatggattaactcgaactcc

SEQ ID NO: 429 - DNA (genomic), 50 bp; double-stranded, linear; identical to SEQ ID NO: 137
  hypothetical: NO
  original source individual isolate: Human factor IX gene

SEQ ID NO: 430 - DNA (genomic), 50 bp; double-stranded, linear
  hypothetical: NO
  original source individual isolate: Human MHC III HLA factor B gene
gcaggtgccagaacacagattgtataaaaggctgggggctggtggggagc

SEQ ID NO: 431 - DNA (genomic), 50 bp; double-stranded, linear
  hypothetical: NO
  original source individual isolate: Human pepsinogen gene
cgataaggcgggacccaacttgtatataagggcagctcatgctgctgctc

SEQ ID NO: 432 - DNA (genomic), 50 bp; double-stranded, linear
  hypothetical: NO
  original source individual isolate: Human pepsinogen C gene
cgattagactaatcttgggcgtataaaagaggaaagagtgcccaggtctt

SEQ ID NO: 433 - DNA (genomic), 50 bp; double-stranded, linear
  hypothetical: NO
  original source individual isolate: Human collagenase gene
ctggaagggcaaggactctatatatacagagggagcttcctagctgggat

SEQ ID NO: 434 - DNA (genomic), 50 bp; double-stranded, linear
  hypothetical: NO
  original source individual isolate: Human stromelysin gene
ccaaacaaacactgtcactctttaaaagctgcgctcccgaggttggacct

SEQ ID NO: 435 - DNA (genomic), 50 bp; double-stranded, linear
  hypothetical: NO
  original source individual isolate: Human alpha-amylase gene
tctgatccgtgcagggtattaatgtgtcagggctgagtgttctgagattt

SEQ ID NO: 436 - DNA (genomic), 50 bp; double-stranded, linear
  hypothetical: NO
  original source individual isolate: Human pancreatic alpha-amylase gene
tgtaaaatgtgcttcttacaggaatataaatagtttctggaaaggacact

SEQ ID NO: 437 - DNA (genomic), 50 bp; double-stranded, linear; identical to SEQ ID NO: 436
  hypothetical: NO
  original source individual isolate: Human pancreatic amylase gene

SEQ ID NO: 438 - DNA (genomic), 50 bp; double-stranded, linear
  hypothetical: NO
  original source individual isolate: human cytochrome P450c gene
gccacacgtacaagcccgcctataaaggtggcagtgccttcaccctcacc

SEQ ID NO: 439 - DNA (genomic), 51 bp; double-stranded, linear
  hypothetical: NO
  original source individual isolate: Human cytochrome P-450c gene
gccacacgtacaagcccgcctataaaggtggcagtgccttcaccctcaccc

SEQ ID NO: 440 - DNA (genomic), 40 bp; double-stranded, linear
  hypothetical: NO
  original source individual isolate: Human gene for cytochrome P(1)-450
cacgtacaagcccgcctataaaggtggcagtgccttcacc

SEQ ID NO: 441 - DNA (genomic), 50 bp; double-stranded, linear
  hypothetical: NO
  original source individual isolate: Human steroid 21-hydroxylase [P450 (C21)] B gene
ggatggctggggctcttgagctataagtggcacctcagggccctgacggg

SEQ ID NO: 442 - DNA (genomic), 50 bp; double-stranded, linear
  hypothetical: NO
  original source individual isolate: Human mitochonrial aldehyde dehydrogenase 2 gene
ttcctgaccatggtacttataaaagcagtgccgtctgccccatccatgtc

SEQ ID NO: 443 - DNA (genomic), 50 bp; double-stranded, linear
  hypothetical: NO
  original source individual isolate: Human carbonic anhydrase III gene
aaggccatgcaagtgtgcgggggagctacataaaagcgcgggctcgcgcg

SEQ ID NO: 444 - DNA (genomic), 50 bp; double-stranded, linear
  hypothetical: NO
  original source individual isolate: Human creatine kinase B isozyme gene
tgggcggcccgcgttgtgccccttaagagccgcgggagcgcggagcggcc

SEQ ID NO: 445 - DNA (genomic), 50 bp; double-stranded, linear
  hypothetical: NO
  original source individual isolate: Human preproenkephalin A gene
cttcggtttggggctaattataaagtggctccagcagccgttaagccccg

SEQ ID NO: 446 - DNA (genomic), 51 bp; double-stranded, linear
  hypothetical: NO
  original source individual isolate: Human preprokephalin A gene
cttcggtttggggctaattataaagtggctccagcagccgttaagccccgg

SEQ ID NO: 447 - DNA (genomic), 50 bp; double-stranded, linear
  hypothetical: NO
  original source individual isolate: Human prepro form of corticotropin releasing factor gene
tttttgaagagggtcgacactataaaatcccactccaggctctggagtgg

SEQ ID NO: 448 - DNA (genomic), 50 bp; double-stranded, linear
  hypothetical: NO
  original source individual isolate: Human preprothyrotropin-releasing hormone gene
gacctcactcgagccgccgcctggcgcagatataagcggcggcccatctg

SEQ ID NO: 449 - DNA (genomic), 50 bp; double-stranded, linear; identical to SEQ ID NO: 399
  hypothetical: NO
  original source individual isolate: Human gene for fetal A-gamma and G-gamma hemoglobin

SEQ ID NO: 450 - DNA (genomic), 50 bp; double-stranded, linear
  hypothetical: NO
  original source individual isolate: Human gene coding for ACTH and beta-LPH precursors
cccaccaggagagctcggcaagtatataaggacagaggagcgcgggacca

SEQ ID NO: 451 - DNA (genomic), 50 bp; double-stranded, linear
  hypothetical: NO
  original source individual isolate: Human somatostatin I gene
tagcctgacgtcagagagagagtttaaaacagagggagacggttgagagc

SEQ ID NO: 452 - DNA (genomic), 50 bp; double-stranded, linear
  hypothetical: NO
  original source individual isolate: Human glucagon gene
gtgaggctaaacagagctggagagtatataaaagcagtgcgccttggtgc

SEQ ID NO: 453 - DNA (genomic), 51 bp; double-stranded, linear
  hypothetical: NO
  original source individual isolate: Human glucagon gene
gtgaggctaaacagagctggagagtatataaaagcagtgcgccttggtgca

SEQ ID NO: 454 - DNA (genomic), 50 bp; double-stranded, linear
  hypothetical: NO
  original source individual isolate: Human chorionic gonadotropin gene
aggtggaaacactctgctggtataaaagcaggtgaggacttcattaactg

SEQ ID NO: 455 - DNA (genomic), 50 bp; double-stranded, linear
  hypothetical: NO
  original source individual isolate: Human chorionic gonadotropin gene
ttgaactgtggtgcaggaaagcctcaagtagaggagggttgaggcttcaa

SEQ ID NO: 456 - DNA (genomic), 50 bp; double-stranded, linear
  hypothetical: NO
  original source individual isolate: Human beta-LH gene
gccgcccccacaaccccgaggtataaagccagatacacgaggcaggggat

SEQ ID NO: 457 - DNA (genomic), 50 bp; double-stranded, linear
  hypothetical: NO
  original source individual isolate: Human follicle-stimulating hormone beta-subunit gene
tagttgcacatgattttgtataaaaggtgaactgagatttcattcagtct

SEQ ID NO: 458 - DNA (genomic), 50 bp; double-stranded, linear
  hypothetical: NO
  original source individual isolate: Human prolactin gene
tattcatgaagatatcaaaggtttataaagccaatatctgggaaagagaa

SEQ ID NO: 459 - DNA (genomic), 50 bp; double-stranded, linear
  hypothetical: NO
  original source individual isolate: Human parathyroid gene
gacatcatctgtaacaataaaagagcctctcttggtaagcagaagaccta

SEQ ID NO: 460 - DNA (genomic), 50 bp; double-stranded, linear
  hypothetical: NO
  original source individual isolate: Owl monkey insulin gene
ggggagatgggctctgggcctataaagccagcagggacccagcagccctc

SEQ ID NO: 461 - DNA (genomic), 50 bp; double-stranded, linear
  hypothetical: NO
  original source individual isolate: human insulin/IGF II gene
ccccgcctccagagtgggggccaaggctgggcaggcgggtggacggccgg

SEQ ID NO: 462 - DNA (genomic), 50 bp; double-stranded, linear
  hypothetical: NO
  original source individual isolate: Human insulin like growth factor IGFII gene
aaagaactctgccttgcgttccccaaaatttgggcattgttccggctcgc

SEQ ID NO: 463 - DNA (genomic), 50 bp; double-stranded, linear
  hypothetical: NO
  original source individual isolate: Human insulin-like growth factor II gene
ccctgggccgcggctggcgcgactataagagccgggcgtgggcgcccgca

SEQ ID NO: 464 - DNA (genomic), 50 bp; double-stranded, linear
  hypothetical: NO
  original source individual isolate: Human gastrin gene
agttgggagggaccttgagggctttataaggcaggcctggagcatcaagc

SEQ ID NO: 465 - DNA (genomic), 50 bp; double-stranded, linear
  hypothetical: NO
  original source individual isolate: Human interferon alpha gene INF-alpha 13
ggaaatcagtatgttccctatttaaggcatctgcaggaagcaaagccttc

SEQ ID NO: 466 - DNA (genomic), 50 bp; double-stranded, linear
  hypothetical: NO
  original source individual isolate: Human gene for leukocyte interferon
ggaagctagtatgttccttatttaagacctatgcacagagcaaggtcttc

SEQ ID NO: 467 - DNA (genomic), 50 bp; double-stranded, linear
  hypothetical: NO
  original source individual isolate: Human interferon alpha gene INF-alpha 4b
ggaaattagtatgttcactatttaagacctatgcacagagcaaagtcttc

SEQ ID NO: 468 - DNA (genomic), 50 bp; double-stranded, linear
  hypothetical: NO
  original source individual isolate: Human gene for leukocyte (alpha) interferon
ggaaattagtatgttcactatttaaggcctatgcacagagcaaagtcttc

SEQ ID NO: 469 - DNA (genomic), 50 bp; double-stranded, linear; identical to SEQ ID NO: 467
  hypothetical: NO
  original source individual isolate: Human interferon genes LeIF-L and LeIF-J

SEQ ID NO: 470 - DNA (genomic), 50 bp; double-stranded, linear
  hypothetical: NO
  original source individual isolate: Human gene for fibroblast (beta-1) interferon
atagagagaggaccatctcatataaataggccatacccacggagaaagga

SEQ ID NO: 471 - DNA (genomic), 50 bp; double-stranded, linear
  hypothetical: NO
  original source individual isolate: Human c-sis gene
ctctcgcactctcccttctcctttataaaggccggaacagctgaaagggt

SEQ ID NO: 472 - DNA (genomic), 50 bp; double-stranded, linear
  hypothetical: NO
  original source individual isolate: Human migratory inhibitory factor-related protein 8
cagctggccaagcctaaccgctataaaaaggagctgcctctcagccctgc

SEQ ID NO: 473 - DNA (genomic), 50 bp; double-stranded, linear
  hypothetical: NO
  original source individual isolate: Human migratory inhibitory factor-related protein 14
gtgccccagtcaggagctgcctataaatgccgagcctgcacagctctggc

SEQ ID NO: 474 - DNA (genomic), 50 bp; double-stranded, linear
  hypothetical: NO
  original source individual isolate: Human epidermal growth factor related gene
ggtccctcctcctcccgccctgcctcccgcgcctcggcccgcgcgagcta

SEQ ID NO: 475 - DNA (genomic), 50 bp; double-stranded, linear
  hypothetical: NO
  original source individual isolate: Human opsin gene
gcttaggagggggaggtcactttataagggtctgggggggtcagaaccca

SEQ ID NO: 476 - DNA (genomic), 50 bp; double-stranded, linear
  hypothetical: NO
  original source individual isolate: Human blue cone photoreceptor pigment gene
ttttgtggggtgggaggatcacctataagaggactcagaggagggtgtgg

SEQ ID NO: 477 - DNA (genomic), 50 bp; double-stranded, linear
  hypothetical: NO
  original source individual isolate: Human red cone photoreceptor pigment gene
cgggctgatcccacaggccagtataaagcgccgtgaccctcaggtgatgc

SEQ ID NO: 478 - DNA (genomic), 50 bp; double-stranded, linear
  hypothetical: NO
  original source individual isolate: Human green cone photoreceptor pigment gene
cgggctgatcccactggccggtataaagcgccgtgaccctcaggtgacgc

SEQ ID NO: 479 - DNA (genomic), 50 bp; double-stranded, linear
  hypothetical: NO
  original source individual isolate: Human interferon-inducible gene IFI-56K
ttggctgctgtttagctcccttatataacactgtcttggggtttaaacgt

SEQ ID NO: 480 - DNA (genomic), 50 bp; double-stranded, linear
  hypothetical: NO
  original source individual isolate: Human interferon-induced 15-Kd protein (ISG) gene
gacgtgtgtgcctcaggcttaataatagggccggtgctgctgcggaagcc

SEQ ID NO: 481 - DNA (genomic), 50 bp; double-stranded, linear
  hypothetical: NO
  original source individual isolate: Human ubiquitin-like protein (GdX) gene
tccagcgcgcgcgcccggggcggcggcgcgcggcggggggtggttggggt

SEQ ID NO: 482 - DNA (genomic), 50 bp; double-stranded, linear
  hypothetical: NO
  original source individual isolate: Human exogenous retrovirus erv3 5" long terminal repeat
ccgcccctgttggttgcatgtataaaagtcaagccctgtcattgttcagg

SEQ ID NO: 483 - RNA (genomic), 50 nt; single-stranded, linear
  hypothetical: NO
  original source individual isolate: Bovine leukemia virus
acctcacctgctgataaattaataaaatgccggccctgtcgagttagcgg

SEQ ID NO: 484 - RNA (genomic), 50 nt; single-stranded, linear
  original source individual isolate: Human T-cell lymphotropic virus type I
tcaataaactagcaggagtctataaaagcgtggagacagttcaggagggg

SEQ ID NO: 485 - RNA (genomic), 50 nt; single-stranded, linear
  original source individual isolate: Human T-cell leukemia virus II proviral LTR
tcaaaataaaagatgccgagtctataaaagcgcaaggacagttcaggagg

SEQ ID NO: 486 - RNA (genomic), 50 nt; single-stranded, linear
  hypothetical: NO
  original source individual isolate: Human T-cell Lymphotropic virus type III  (HIV-1)
ggcgagccctcagatcctgcatataagcagctgctttttgcctgtactgg

SEQ ID NO: 487 - RNA (genomic), 50 nt; single-stranded, linear
  hypothetical: NO
  original source individual isolate: Aids-associated retrovirus (arv-2;proviral)
tggcgtccctcagatgctgcatataagcagctgctttttgcctgtactgg

SEQ ID NO: 488 - RNA (genomic), 50 nt; single-stranded, linear
  hypothetical: NO
  original source individual isolate: Human immunodeficiency virus type 2 (HIV-2)
gccctcatattctctgtataaatatacccgctagcttgcattgtacttcg

SEQ ID NO: 489 - RNA (genomic), 50 nt; single-stranded, linear
  original source individual isolate: Visna lentivirus, Icelandic strains LV1-1
cataaccgcagatgtaaacaagttgcctatataagccgcttgctagctgg

SEQ ID NO: 490 - DNA (genomic), 50 bp; double-stranded, linear
  hypothetical: NO
  original source individual isolate: Human cytomegalovirus strain AD169 gene I
ggcgtgtacggtgggaggtctatataagcagagctcgtttagtgaaccgt

SEQ ID NO: 491 - DNA (genomic), 50 bp; double-stranded, linear
  hypothetical: NO
  original source individual isolate: Murine cytomegalovirus intermediate-early gene I
gctgagctgcgttcacgtgggtataagaggcgcgaccagcgtcggtaccg

SEQ ID NO: 492 - DNA (genomic), 50 bp; double-stranded, linear
  hypothetical: NO
  original source individual isolate: Human cytomegalovirus intermediate-early glycoprotein UL37
cgtcatgtccggcatcttcatgtatataagacggtgtttcaagacgacgt

SEQ ID NO: 493 - DNA (genomic), 50 bp; double-stranded, linear
  hypothetical: NO
  original source individual isolate: Human cytomegalovirus I-E glycoprotein US3 gene
acaacgtcaccaagaaacgctatatattcaaaaacaccgttcagtccaca

SEQ ID NO: 494 - DNA (genomic), 50 bp; double-stranded, linear
  hypothetical: NO
  original source individual isolate: Herpes Simplex Virus type 1 gene I
tttggggaggggaaaggcgtggggtataagttagccctggcccgacagtc

SEQ ID NO: 495 - DNA (genomic), 50 bp; double-stranded, linear
  hypothetical: NO
  original source individual isolate: Herpes Simplex Virus type 1 gene II
agccggccccggcaccacgggtataaggacatccaccacccggccggtgg

SEQ ID NO: 496 - DNA (genomic), 50 bp; double-stranded, linear
  hypothetical: NO
  original source individual isolate: Herpes simplex virus type II I-E gene II
agccggccccggtcgtgcgggtataagggcagccaccggcccactgggcg

SEQ ID NO: 497 - DNA (genomic), 50 bp; double-stranded, linear
  hypothetical: NO
  original source individual isolate: Herpes simplex virus type I I-E gene III
ttcccgccggcccctgggactatatgagcccgaggacgccccgatcgtcc

SEQ ID NO: 498 - DNA (genomic), 50 bp; double-stranded, linear
  hypothetical: NO
  original source individual isolate: Herpes simplex virus type II I-E gene III
ccccgcgcgccccgagcgactatatcagccaggcgacggggcgatcgtcc

SEQ ID NO: 499 - DNA (genomic), 50 bp; double-stranded, linear
  hypothetical: NO
  original source individual isolate: Herpes simplex virus type 1 I-E genes IV and V
gggggcgggtctctccggcgcacataaaggcccggcgcgaccgacgcccg

SEQ ID NO: 500 - DNA (genomic), 50 bp; double-stranded, linear
  hypothetical: NO
  original source individual isolate: Herpes simplex virus type 2 I-E genes IV and V
acggggggcgggccgttcctcgcgcacataaagggccggcgtcccggtcg

SEQ ID NO: 501 - DNA (genomic), 50 bp; double-stranded, linear
  hypothetical: NO
  original source individual isolate: Human cytomegalovirus DNA polymersase gene
taggcgggctggaaagatgatgtataaatagagtctgcgacggggttcgg

SEQ ID NO: 502 - DNA (genomic), 50 bp; double-stranded, linear; identical to SEQ ID NO: 501
  hypothetical: NO
  original source individual isolate: Human cytomegalovirus b' 2.2 kb transcript (start 160513)

SEQ ID NO: 503 - DNA (genomic), 50 bp; double-stranded, linear
  hypothetical: NO
  original source individual isolate: Human cytomegalovirus 2.7 kb transcript (start 4578)
gcccgcgctcggcagagctaccatataaaaacgcaggggtttagcagctt

SEQ ID NO: 504 - DNA (genomic), 50 bp; double-stranded, linear
  hypothetical: NO
  original source individual isolate: Herpes simplex virus-1 b' 82K AlkExo (start 27048)
cagcaccaggagaggcttaagctcgggaggcagcgccaccgacgacagta

SEQ ID NO: 505 - DNA (genomic), 50 bp; double-stranded, linear
  hypothetical: NO
  original source individual isolate: Herpes simplex virus-1 b' 42K gene (start site 106547)
atgggttgtggttatatgcacttcctataagactctcccccaccgcccac

SEQ ID NO: 506 - DNA (genomic), 50 bp; double-stranded, linear
  hypothetical: NO
  original source individual isolate: Herpes simplex virus-1 39k dUTPase gene (start 106811)
cgtgtgcgataatacacacgcccatcgaggccatgcctacataaaagggc

SEQ ID NO: 507 - DNA (genomic), 50 bp; double-stranded, linear
  hypothetical: NO
  original source individual isolate: Herpes simplex virus-1 b' 33K (start site 145165)
ggccgggcgacccagatgtttacttaaaaggcgtgccgtccgccggcatg

SEQ ID NO: 508 - DNA (genomic), 50 bp; double-stranded, linear
  hypothetical: NO
  original source individual isolate: Herpes simplex virus-1 21K (start site 145459)
cgacgtacgcgatgagatcaataaaagggggcgtgaggaccgggaggcgg

SEQ ID NO: 509 - DNA (genomic), 50 bp; double-stranded, linear
  hypothetical: NO
  original source individual isolate: Herpes simplex virus-1 b' 5 kb transcript (start 86216)
ccccacccctgcgcgatgtggataaaaagccagcgcgggtggtttagggt

SEQ ID NO: 510 - DNA (genomic), 50 bp; double-stranded, linear
  hypothetical: NO
  original source individual isolate: Herpes simplex virus-1 b' RNR2 gene (start 89774)
ggtccgccttctggtccacgcatataagcgcggactaaaaacagggatgt

SEQ ID NO: 511 - DNA (genomic), 50 bp; double-stranded, linear
  hypothetical: NO
  original source individual isolate: Herpes simplex virus-2 RNR2 gene (start site 247)
tggtccgccttctcgtccacgcatataagcgcggcctgaagacggggatg

SEQ ID NO: 512 - DNA (genomic), 50 bp; double-stranded, linear
  hypothetical: NO
  original source individual isolate: Herpes simplex virus-1 b' tk gene (start site 47911)
cgcggtcccaggtccacttcgcatattaaggtgacgcgtgtggcctcgaa

SEQ ID NO: 513 - DNA (genomic), 50 bp; double-stranded, linear
  hypothetical: NO
  original source individual isolate: Herpes simplex virus-2 b' tk gene (start site 225)
cgcggcccgaggtccacttcgcatattaaggtgacgcgcgtggcctcgaa

SEQ ID NO: 514 - DNA (genomic), 50 bp; double-stranded, linear
  hypothetical: NO
  original source individual isolate: Herpes simplex virus-1 b' dbp gene (start site 62318)
cggcacgcccccaggtaaagtgtacatataccaaccgcataccagacgca

SEQ ID NO: 515 - DNA (genomic), 50 bp; double-stranded, linear
  hypothetical: NO
  original source individual isolate: Herpes simplex virus-1 b' gB (3.3 Kb) start 56081
ccactcagcgcgccgcctggcgatatattcgcgagctgattatcgccacc

SEQ ID NO: 516 - DNA (genomic), 50 bp; double-stranded, linear; identical to SEQ ID NO: 515
  hypothetical: NO
  original source individual isolate: Herpes simplex virus-1 b' gD  (start 138337)

SEQ ID NO: 517 - DNA (genomic), 50 bp; double-stranded, linear
  hypothetical: NO
  original source individual isolate: Herpes simplex virus-2 b' gD (start 5918)
ggagtataatagagtctttgtgtttaaaacccggggtcggtgtggtgttc

SEQ ID NO: 518 - DNA (genomic), 50 bp; double-stranded, linear
  hypothetical: NO
  original source individual isolate: Herpes simplex virus-1 b' gE (start site 141171)
ggagagggcccgcggcgcatttaaggcgttgttgtgttgactttgcctct

SEQ ID NO: 519 - DNA (genomic), 50 bp; double-stranded, linear
  hypothetical: NO
  original source individual isolate: Herpes simplex virus-1 ICP gene (start site 58361)
aattattgctacgacatccgtgcttgtttgtgttccgtgtctatatctct

SEQ ID NO: 520 - DNA (genomic), 50 bp; double-stranded, linear
  hypothetical: NO
  original source individual isolate: Herpes simplex virus-1 b' tr-4 (start site 136729)
ggcggtgctgtttgcgggttggcacaaaaagaccccgatccgcgtctgtg

SEQ ID NO: 521 - DNA (genomic), 50 bp; double-stranded, linear
  hypothetical: NO
  original source individual isolate: Herpes simplex virus-1 [U-S] b' tr-9 (start 143245)
gtgacgtcaattgcccgaggcgcataaagggccggtggtccgcctagccg

SEQ ID NO: 522 - DNA (genomic), 50 bp; double-stranded, linear
  hypothetical: NO
  original source individual isolate: Herpes simplex virus-1 b'g' VP5 (start 40768)
ggggtggggcgggggggggggtatataaggcctgggatcccacgtccccg

SEQ ID NO: 523 - DNA (genomic), 50 bp; double-stranded, linear
  hypothetical: NO
  original source individual isolate: Herpes simplex virus-1 b'g' 2.1kb transcript (start 26639)
cccgttaaccccccacgtgatcagcacgccaccgacaccgcagacgaaaa

SEQ ID NO: 524 - DNA (genomic), 50 bp; double-stranded, linear
  hypothetical: NO
  original source individual isolate: Herpes simplex virus-1 b'g' a'TIF/VSP  (start 105259)
ggggcggcccgtgcgggttgcttaaatgcgtggtggcgaccacgggctgt

SEQ ID NO: 525 - DNA (genomic), 50 bp; double-stranded, linear
  hypothetical: NO
  original source individual isolate: Herpes simplex virus-1 b'g' 2.7 kb transcript (start 100998)
gccacgcccataagctcctcccgataaaaagcgccccgatggccctggac

SEQ ID NO: 526 - DNA (genomic), 50 bp; double-stranded, linear
  hypothetical: NO
  original source individual isolate: Human cytomegalovirus UL36 gene (start 49862)
gacgtcaacgctgatagtgtctataaaggccgtgccgccgcgccgtagtt

SEQ ID NO: 527 - DNA (genomic), 50 bp; double-stranded, linear
  hypothetical: NO
  original source individual isolate: Human cytomegalovirus g' pp65 gene (start 121072)
tccgcgtttggtcgcctgcctatgtaaggcggcggccgcagagggcgcgc

SEQ ID NO: 528 - DNA (genomic), 50 bp; double-stranded, linear
  hypothetical: NO
  original source individual isolate: Human cytomegalovirus g' pp71 gene (start 119223)
gtcaccgctgctatatttgcgacagttgccggaacccttcccgacctccc

SEQ ID NO: 529 - DNA (genomic), 50 bp; double-stranded, linear
  hypothetical: NO
  original source individual isolate: Human cytomegalovirus g' pp150 gene (start 43092)
cgtatccgcctccgctattaaactaccccccctccctctaggtggggcgc

SEQ ID NO: 530 - DNA (genomic), 50 bp; double-stranded, linear
  hypothetical: NO
  original source individual isolate: Herpes simplex virus-1 g' 5 Kb transcript (start 103313)
ttgtgtcgcagggcggcccgcgtataaaggcgagagcgcgggaccgtttc

SEQ ID NO: 531 - DNA (genomic), 50 bp; double-stranded, linear
  hypothetical: NO
  original source individual isolate: Herpes simplex virus-1 g' gC (start 96170)
aaccccggatggggcccgggtataaattccggaaggggacacgggctacc

SEQ ID NO: 532 - DNA (genomic), 50 bp; double-stranded, linear
  hypothetical: NO
  original source individual isolate: Herpes simplex virus-2 g' gC (start 670)
gcgggggtgccgtggacgggtataaaggccaggggggcacgcgggcccat

SEQ ID NO: 533 - DNA (genomic), 50 bp; double-stranded, linear
  hypothetical: NO
  original source individual isolate: Herpes simplex virus-1 g' gH gene (start 46581)
cggcaataaaaagacagaataaaacgcacgggtgttgggtcgtttgttca

SEQ ID NO: 534 - DNA (genomic), 50 bp; double-stranded, linear
  hypothetical: NO
  original source individual isolate: Herpes simplex virus-1 g' 42 K (start site 107130)
ccggagtccccgctaaccttcggcataaaagccaccgcgcgcctgttgac

SEQ ID NO: 535 - DNA (genomic), 50 bp; double-stranded, linear
  hypothetical: NO
  original source individual isolate: Herpes simplex virus-1 Ori_s ORF (start site 132287)
cggaggcccccggggtgcgtcccctgtgtttcgtgggtggggtgggcggg

SEQ ID NO: 536 - DNA (genomic), 50 bp; double-stranded, linear
  hypothetical: NO
  original source individual isolate: Herpes simplex virus-1 18 K  (start site 97951)
cccgcccaccgctgggcgctataaagccgccaccctctcttccctcaggt

SEQ ID NO: 537 - DNA (genomic), 50 bp; double-stranded, linear
  hypothetical: NO
  original source individual isolate: Herpes simplex virus-2  18K  (start site 2391)
ccccgccgtcccccgggcgttataagccgccgcactcgcttttcccaccg

SEQ ID NO: 538 - DNA (genomic), 50 bp; double-stranded, linear
  hypothetical: NO
  original source individual isolate: Epstein Barr virus L1 1Kb gene (start site 103194)
tggtgccttggctttaaaggggagatgttagacaggtaactcactaaaca

SEQ ID NO: 539 - DNA (genomic), 50 bp; double-stranded, linear
  hypothetical: NO
  original source individual isolate: Epstein Barr virus  R1 145K gene (start site 1721)
actgtataaaggtaagtattattaaattttagagacactatcacgtgtaa

SEQ ID NO: 540 - DNA (genomic), 50 bp; double-stranded, linear
  hypothetical: NO
  original source individual isolate: Epstein Barr virus  R1 20K  (start site 9660)
cttttagccatgccatgctctataaatcacttccctatctcaggtaggcc

SEQ ID NO: 541 - DNA (genomic), 50 bp; double-stranded, linear
  hypothetical: NO
  original source individual isolate: Epstein Barr virus [DL/R]   (start site 52787)
acagagaccccaaaaagaggataaaagaaggcgagccggcccggctcgcc

SEQ ID NO: 542 - DNA (genomic), 50 bp; double-stranded, linear
  hypothetical: NO
  original source individual isolate: Epstein Barr virus R2  (start site 61372)
gtgacggtcaggcagctcctgtatttaactttgcggacagaggccagagc

SEQ ID NO: 543 - DNA (genomic), 50 bp; double-stranded, linear
  hypothetical: NO
  original source individual isolate: Epstein Barr virus L2  (start site 57050)
taattacgcttgtgtacatatttaaatccacacaagtggccagagtgggc

SEQ ID NO: 544 - DNA (genomic), 50 bp; double-stranded, linear
  hypothetical: NO
  original source individual isolate: Epstein Barr virus  R1  (start site 88539)
gacagggacggcggcgctatatataagagcccaagacccggctctcttta

SEQ ID NO: 545 - DNA (genomic), 50 bp; double-stranded, linear
  hypothetical: NO
  original source individual isolate: Epstein Barr virus R2  (start site 88897)
cggattagatggggatatttaaaaggggcagcaatctcggctgtttgtac

SEQ ID NO: 546 - DNA (genomic), 50 bp; double-stranded, linear
  hypothetical: NO
  original source individual isolate: Epstein Barr virus L2  (start site 90021)
acccaacaggtggtgaaaatataacacaggtgacaccagcctctatcagc

SEQ ID NO: 547 - DNA (genomic), 50 bp; double-stranded, linear
  hypothetical: NO
  original source individual isolate: Epstein Barr virus [BamH1-L] L1 (start site 92157)
accccccttgtacctattaaagaggatgctgcctagaaatcggtgccgag

SEQ ID NO: 548 - DNA (genomic), 50 bp; double-stranded, linear
  hypothetical: NO
  original source individual isolate: Epstein Barr virus [BamH1-L] L3 (start site 88480)
cgggtcttgggctcttatatatagcgccgccgtccctgtctgttagatca

SEQ ID NO: 549 - DNA (genomic), 50 bp; double-stranded, linear
  hypothetical: NO
  original source individual isolate: Epstein Barr virus [BamH1-K] 2.1 Kb (start site 109939)
agacgccctcaatcgtattaaaagccgtgtattcccccgcactaaagaat

SEQ ID NO: 550 - DNA (genomic), 50 bp; double-stranded, linear
  hypothetical: NO
  original source individual isolate: Epstein Barr virus [BamH1-K] 1.3kb transcript (start 110632)
ttgcgacccctctgatattaaggtggttattttgggccaggacccctatc

SEQ ID NO: 551 - DNA (genomic), 50 bp; double-stranded, linear
  hypothetical: NO
  original source individual isolate: Epstein Barr virus [EcoR1-H] L1 (start site 137680)
cggtgcccggactcagaattattaaaccgggtggcagctcctggcagtca

SEQ ID NO: 552 - DNA (genomic), 50 bp; double-stranded, linear
  hypothetical: NO
  original source individual isolate: Epstein Barr virus [EcoR1-D]  L1 (start site 159337)
aagggcagggggtgggtatttaaggatctatatgcccttctctacctgca

SEQ ID NO: 553 - DNA (genomic), 50 bp; double-stranded, linear
  hypothetical: NO
  original source individual isolate: Epstein Barr virus [EcoR1-D] R1 (start 165496)
aatgggcgtggcagaatagtataagacgcgaggcctgggtgaggagagtc

SEQ ID NO: 554 - DNA (genomic), 50 bp; double-stranded, linear
  hypothetical: NO
  original source individual isolate: Epstein Barr virus [EcoR1-D] L2 (start 167495)
tctttccttgtccttactgtataaaagtccacgaaaacagctgtgcctca

SEQ ID NO: 555 - DNA (genomic), 50 bp; double-stranded, linear
  hypothetical: NO
  original source individual isolate: Epstein Barr Virus [EcoR1-D] L1A start 169165
actgatgagtaagtattacaccctttgccccacaccccctttcccttact

SEQ ID NO: 556 - DNA (genomic), 50 bp; double-stranded, linear
  hypothetical: NO
  original source individual isolate: Epstein Barr Virus [EBNA] E1 (start site 11333)
agggggggactaaggtcccactacaaaaactctgtgttctgctgcaaatt

SEQ ID NO: 557 - DNA (genomic), 50 bp; double-stranded, linear
  hypothetical: NO
  original source individual isolate: Epstein Barr virus [EBNA] E2  (start site 14399)
ggtataaagtggtcctgcagctatttctggtcgcatcagagcgccaggag

SEQ ID NO: 558 - DNA (genomic), 50 bp; double-stranded, linear
  hypothetical: NO
  original source individual isolate: Epstein Barr virus  [EcoR1-D] L1 (start site 169514)
ctctgacgtagccgccctacataagcctctcacactgctctgcccccttc

SEQ ID NO: 559 - DNA (genomic), 50 bp; double-stranded, linear
  hypothetical: NO
  original source individual isolate: Adenovirus type 2   EIa (start 498)
gtcagctgacgcgcagtgtatttatacccggtgagttcctcaagaggcca

SEQ ID NO: 560 - DNA (genomic), 50 bp; double-stranded, linear
  hypothetical: NO
  original source individual isolate: Adenovirus type-5  EIa  (start 499)
gtcagctgacgtgtagtgtatttatacccggtgagttcctcaagaggcca

SEQ ID NO: 561 - DNA (genomic), 50 bp; double-stranded, linear
  hypothetical: NO
  original source individual isolate: Adenovirus type-7 EIa  (start site 512)
tcagctgatcgctagggtatttaaacctgacgagttccgtcaagaggcca

SEQ ID NO: 562 - DNA (genomic), 50 bp; double-stranded, linear
  hypothetical: NO
  original source individual isolate: Adenovirus type-12  E1a  (start site 306)
aaattgatgacggcaattttattataggcgcggaatatttaccgagggca

SEQ ID NO: 563 - DNA (genomic), 50 bp; double-stranded, linear
  hypothetical: NO
  original source individual isolate: Adenovirus type-12  EIa  (start site 445)
gtcagctgatcgtttgggtatttaatgccgccgtgttcgtcaagaggcca

SEQ ID NO: 564 - DNA (genomic), 50 bp; double-stranded, linear
  hypothetical: NO
  original source individual isolate: Simian Adenovirus SA7 EIa  (start site 440)
ttattgtctaggtgagggtatttaaaccggctcagaccgtcaagaggcca

SEQ ID NO: 565 - DNA (genomic), 50 bp; double-stranded, linear
  hypothetical: NO
  original source individual isolate: Adenovirus type-2  EIb  (start 1700)
ggggcggggcttaaagggtatataatgcgccgtgggctaatcttggttac

SEQ ID NO: 566 - DNA (genomic), 50 bp; double-stranded, linear; identical to SEQ ID NO: 565
  hypothetical: NO
  original source individual isolate: Adenovirus type-5  EIb (start site 1703)

SEQ ID NO: 567 - DNA (genomic), 50 bp; double-stranded, linear
  hypothetical: NO
  original source individual isolate: Adenovirus type-7  EIb  (start site 1577)
ttcttgggtggggtcttggatatataagtaggagcagatctgtgtggtta

SEQ ID NO: 568 - DNA (genomic), 50 bp; double-stranded, linear
  hypothetical: NO
  original source individual isolate: Adenovirus type-12  EIb  (start site 1527)
tgggcgtggttaaacagggatataaagctgggttggtgttgctttgaata

SEQ ID NO: 569 - DNA (genomic), 50 bp; double-stranded, linear
  hypothetical: NO
  original source individual isolate: Adenovirus type-2 EII  (start site 27092)
gaaagggcgcgaaactagtccttaagagtcagcgcgcagtatttgctgaa

SEQ ID NO: 570 - DNA (genomic), 50 bp; double-stranded, linear
  hypothetical: NO
  original source individual isolate: Adenovirus type-2 EIII  (start site 27610)
tgcggtcgcccgggcagggtataactcacctgaaaatcagagggcgaggt

SEQ ID NO: 571 - DNA (genomic), 50 bp; double-stranded, linear
  hypothetical: NO
  original source individual isolate: Adenovirus type-5 EIII  (start site 239)
tgcggtcgcccgggcagggtataactcacctgactcttggagggcgaggt

SEQ ID NO: 572 - DNA (genomic), 50 bp; double-stranded, linear
  hypothetical: NO
  original source individual isolate: Adenovirus type-2 EIV  (start site 35611)
ttacgtcattttttagtcctatatatactcgctctgtacttggccctttt

SEQ ID NO: 573 - DNA (genomic), 50 bp; double-stranded, linear
  hypothetical: NO
  original source individual isolate: Adenovirus type-2 IVa2 (start site 5827)
ccctcccacttagcctccttcgtgctggcctggacgcgagccttcgtctc

SEQ ID NO: 574 - DNA (genomic), 50 bp; double-stranded, linear
  hypothetical: NO
  original source individual isolate: Adenovirus type-5 IVa2  (start site 5837)
ccctcccacttagcctccttcgtgctggcctggacgcgagcctttgtctc

SEQ ID NO: 575 - DNA (genomic), 50 bp; double-stranded, linear
  hypothetical: NO
  original source individual isolate: Adenovirus type-7  IVa2   (start site 5692)
ccctcccacgtggcctcctttgtgctggcctggacacgcgcttttgtatc

SEQ ID NO: 576 - DNA (genomic), 50 bp; double-stranded, linear
  hypothetical: NO
  original source individual isolate: Adenovirus type-2 IX  (start site 3575)
gcttaagggtgggaaagaatatataaggtgggggtctcatgtagttttgt

SEQ ID NO: 577 - DNA (genomic), 50 bp; double-stranded, linear
  hypothetical: NO
  original source individual isolate: Adenovirus type-5  IX  (start site 3581)
gcttaagggtgggaaagaatatataaggtgggggtcttatgtagttttgt

SEQ ID NO: 578 - DNA (genomic), 50 bp; double-stranded, linear
  hypothetical: NO
  original source individual isolate: Adenovirus type-7  IX  (start site 3460)
atggggactttcaggttggtaaggtggacaaattgggtaaattttgttaa

SEQ ID NO: 579 - DNA (genomic), 50 bp; double-stranded, linear
  hypothetical: NO
  original source individual isolate: Adenovirus type-2  major late (start site 6039)
gtgttcctgaaggggggctataaaagggggtgggggcgcgttcgtcctca

SEQ ID NO: 580 - DNA (genomic), 50 bp; double-stranded, linear; identical to SEQ ID NO: 579
  hypothetical: NO
  original source individual isolate: Adenovirus type-5  major late (start site 6049)

SEQ ID NO: 581 - DNA (genomic), 50 bp; double-stranded, linear
  hypothetical: NO
  original source individual isolate: Adenovirus type-7  major late (start site 5904)
gggtccccgccgggggggtataaaagggggcggacctctgttcgtcctca

SEQ ID NO: 582 - DNA (genomic), 50 bp; double-stranded, linear
  hypothetical: NO
  original source individual isolate: Adenovirus type-12  major late (start site 972)
aattttctggtggtgggctataaaaaggggcgggtccttggtcttcatcg

SEQ ID NO: 583 - DNA (genomic), 50 bp; double-stranded, linear
  hypothetical: NO
  original source individual isolate: Adenovirus type-2  LIIa  (start site 25954)
ggcgtggtagtcctcaggtacaaatttgcgaaggtaagccgacgtccaca

SEQ ID NO: 584 - DNA (genomic), 50 bp; double-stranded, linear
  hypothetical: NO
  original source individual isolate: Human papilloma virus type 18  E6 gene (start site 30)
cagcacatactatacttttcattaatacttttaacaattgtagtatataa

SEQ ID NO: 585 - DNA (genomic), 50 bp; double-stranded, linear
  hypothetical: NO
  original source individual isolate: Human papilloma virus type-16 E6/E7 (start site 97)
gaaccgaaaccggttagtataaaagcagacattttatgcaccaaaagaga

SEQ ID NO: 586 - DNA (genomic), 50 bp; double-stranded, linear
  hypothetical: NO
  original source individual isolate: Human papilloma virus type-18  E6 (start site 105)
ggaccgaaaacggtgtatataaaagatgtgagaaacacaccacaatacta

SEQ ID NO: 587 - DNA (genomic), 50 bp; single-stranded, linear
  hypothetical: NO
  original source individual isolate: Parvovirus h-1  H-1[+.04]  (start site 209)
agtgggcgtggctaactgtatataagcagtcactctggtcggttactcac

SEQ ID NO: 588 - DNA (genomic), 50 bp; single-stranded, linear
  hypothetical: NO
  original source individual isolate: Parvovirus h-1  H-1 [+.40]  (start site 2010)
gccgaagctagacactcctataaattcgctaggttcaatgcgctcaccat

SEQ ID NO: 589 - DNA (genomic), 50 bp; single-stranded, linear
  hypothetical: NO
  original source individual isolate: Human parvovirus B19-Au  B19 [0.06] (start site 347)
gagcgtaggcggggactacagtatatatagcacggtactgccgcagctct

SEQ ID NO: 590 - DNA (genomic), 50 bp; single-stranded, linear
  hypothetical: NO
  original source individual isolate: Simian virus 40  T/t late (start site 31)
ccgcccctaactccgcccagttccgcccattctccgccccatggctgact

SEQ ID NO: 591 - DNA (genomic), 50 bp; double-stranded, linear
  original source individual isolate: Simian virus 40 T/t early P2  (start site 5233)
tggctgactaattttttttatttatgcagaggccgaggccgcctcggcct

SEQ ID NO: 592 - DNA (genomic), 50 bp; double-stranded, linear
  hypothetical: NO
  original source individual isolate: BK virus T/t early (start site 99)
cctgtggcctttttttttataatatataagaggccgaggccgcctctgcc

SEQ ID NO: 593 - DNA (genomic), 50 bp; double-stranded, linear
  hypothetical: NO
  original source individual isolate: Polyoma virus T/t E   (start site 156)
ggccacccaaattgatataattaagccccaaccgcctcttcccgcctcat

SEQ ID NO: 594 - DNA (genomic), 50 bp; double-stranded, linear
  hypothetical: NO
  original source individual isolate: Simian virus 40 late  (start site 325)
gttctttccgcctcagaaggtacctaaccaagttcctctttcagaggtta

SEQ ID NO: 595 - DNA (genomic), 50 bp; double-stranded, linear
  hypothetical: NO
  original source individual isolate: Hepatitis B virus subtype adr4 3.6kb P1 (start 1659)
agttgggggaggagattaggttaaaggtctttgtactaggaggctgtagg

SEQ ID NO: 596 - DNA (genomic), 50 bp; double-stranded, linear
  hypothetical: NO
  original source individual isolate: Heptitis B virus subtype adr4 3.6 kb P2 (start 1690)
tgtactaggaggctgtaggcataaattggtctgttcaccagcaccatgca

SEQ ID NO: 597 - DNA (genomic), 50 bp; double-stranded, linear
  hypothetical: NO
  original source individual isolate: Hepatitis B virus subtype adr4 2.2 kb P1 (start 3061)
atcggcagtcaggaagacagcctactcccatctctccacctctaagagac

SEQ ID NO: 598 - DNA (genomic), 50 bp; double-stranded, linear
  hypothetical: NO
  original source individual isolate: Hepatitis B virus subtype adr4 2.2 kb P2 (start 3092)
ctctccacctctaagagacagtcatcctcaggccatgcagtggaactcca

SEQ ID NO: 599 - DNA (genomic), 50 bp; double-stranded, linear
  hypothetical: NO
  original source individual isolate: Epstein Barr virus [BamH1-F] R1 (start 58862)
tatttttgaaaagggatattataaaacaggtcattgctcggattgtggca

SEQ ID NO: 600 - DNA (genomic), 56 bp; double-stranded, linear
  hypothetical: NO
  original source individual isolate: Promoter Sequence of IL-13
ggtgtgaggcgtcaccacttgggcctataaaagctgccacaagacgccaaggccac

SEQ ID NO: 601 - DNA (genomic), 11 bp; double-stranded, linear
  hypothetical: NO
  anti-sense: NO
  original source individual isolate: UL9 BINDING SITE, HSV oriS, higher affinity
cgttcgcactt

SEQ ID NO: 602 - DNA (genomic), 11 bp; double-stranded, linear
  hypothetical: NO
  anti-sense: NO
  original source individual isolate: UL9 BINDING SITE, HSV oriS, lower affinity
tgctcgcactt

SEQ ID NO: 603 - DNA (genomic), 30 bp; double-stranded, linear
  hypothetical: NO
  anti-sense: NO
  original source individual isolate: UL9Z1 TEST SEQ. / UL9 ASSAY SEQ.
gcgcgcgcgcgttcgcacttccgccgccgg

SEQ ID NO: 604 - DNA (genomic), 30 bp; double-stranded, linear
  hypothetical: NO
  anti-sense: NO
  original source individual isolate: UL9Z2 TEST SEQ. / UL9 ASSAY SEQ.
ggcgccggccgttcgcacttcgcgcgcgcg

SEQ ID NO: 605 - DNA (genomic), 30 bp; double-stranded, linear
  hypothetical: NO
  anti-sense: NO
  original source individual isolate: UL9 CCCG TEST SEQ. / UL9 ASSAY SEQ.
ggcccgccccgttcgcacttcccgccccgg

SEQ ID NO: 606 - DNA (genomic), 30 bp; double-stranded, linear
  hypothetical: NO
  anti-sense: NO
  original source individual isolate: UL9 GGGC TEST SEQ. / UL9 ASSAY SEQ.
ggcgggcgccgttcgcacttgggcgggcgg

SEQ ID NO: 607 - DNA (genomic), 30 bp; double-stranded, linear
  hypothetical: NO
  anti-sense: NO
  original source individual isolate: UL9 ATAT TEST SEQ. / UL9 ASSAY SEQ.
ggatatatacgttcgcactttaattattgg

SEQ ID NO: 608 - DNA (genomic), 30 bp; double-stranded, linear
  hypothetical: NO
  anti-sense: NO
  original source individual isolate: UL9 polyA TEST SEQ. / UL9 ASSAY SEQ.
ggaaaaaaacgttcgcacttaaaaaaaagg

SEQ ID NO: 609 - DNA (genomic), 30 bp; double-stranded, linear
  hypothetical: NO
  anti-sense: NO
  original source individual isolate: UL9 polyT TEST SEQ. /  UL9 ASSAY SEQ.
ggtttttttcgttcgcacttttttttttgg

SEQ ID NO: 610 - DNA (genomic), 30 bp; double-stranded, linear
  hypothetical: NO
  anti-sense: NO
  original source individual isolate: UL9 GCAC TEST SEQ. / UL9 ASSAY SEQ.
ggacgcacgcgttcgcacttgcagcagcgg

SEQ ID NO: 611 - DNA (genomic), 30 bp; double-stranded, linear
  hypothetical: NO
  anti-sense: NO
  original source individual isolate: UL9 ATori-1 Test sequence / UL9 ASSAY SEQ.
gcgtatatatcgttcgcacttcgtcccaat

SEQ ID NO: 612 - DNA (genomic), 31 bp; double-stranded, linear
  hypothetical: NO
  anti-sense: NO
  original source individual isolate: oriECO2 TEST SEQ. / UL9 ASSAY SEQ.
ggcgaattcgacgttcgcacttcgtcccaat

SEQ ID NO: 613 - DNA (genomic), 32 bp; double-stranded, linear
  hypothetical: NO
  anti-sense: NO
  original source individual isolate: oriECO3 TEST SEQ. / UL9 ASSAY SEQ.
ggcgaattcgatcgttcgcacttcgtcccaat

SEQ ID NO: 614 - DNA (genomic), 36 bp; double-stranded, linear
  hypothetical: NO
  anti-sense: NO
  original source individual isolate: WILD TYPE
aagtgagaattcgaagcgttcgcacttcgtcccaat

SEQ ID NO: 615 - DNA (genomic), 9 bp; double-stranded, linear
  hypothetical: NO
  anti-sense: NO
  original source individual isolate: TRUNCATED UL9 BINDING SITE, COMPARE SEQ ID NO:601
ttcgcactt

SEQ ID NO: 616 - DNA (genomic), 17 bp; double-stranded, linear
  hypothetical: NO
  anti-sense: NO
  original source individual isolate: HSVB1/4, SEQUENCE OF COMPETITOR DNA MOLECULE
ggtcgttcgcacttcgc

SEQ ID NO: 617 - DNA (genomic), 37 bp; single-stranded, linear
  hypothetical: NO
  original source individual isolate: Figure 14B, top strand of an exemplary target sequence
gcgtannnnncgttcgcacttnnnncttcgtcccaat

SEQ ID NO: 618 - DNA (genomic), 12 bp; single-stranded, linear
  hypothetical: NO
  original source individual isolate: HSV primer
attgggacgaag

SEQ ID NO: 619 - DNA (genomic), 11 bp; single-stranded, linear
  hypothetical: NO
  original source individual isolate: a sample distamycin target sequence
ttcctcctttc

SEQ ID NO: 620 - DNA (genomic), 11 bp; single-stranded, linear
  hypothetical: NO
  original source individual isolate: a distamycin target sequence
ttccnnntttc

SEQ ID NO: 621 - DNA, 37 bp; double-stranded, linear; identical to SEQ ID NO: 617
  hypothetical: YES
  original source individual isolate: Figure 27A, test oligonucleotide

SEQ ID NO: 622 - DNA, 37 bp; double-stranded, linear; identical to SEQ ID NO: 617
  hypothetical: YES
  original source individual isolate: Figure 27B, oligonucleotide

SEQ ID NO: 623 - DNA, 37 bp; double-stranded, linear
  hypothetical: YES
  original source individual isolate: Figure 27C, oligonucleotide
gcgtannnnnaagtgcgaacgnnnncttcgtcccaat

SEQ ID NO: 624 - DNA, 37 bp; double-stranded, linear; identical to SEQ ID NO: 623
  hypothetical: YES
  original source individual isolate: Figure 27D, oligonucleotide

SEQ ID NO: 625 - DNA (genomic), 6 bp; double-stranded, linear
  hypothetical: NO
  original source individual isolate: -35 region consensus sequence
ttgaca

SEQ ID NO: 626 - DNA (genomic), 6 bp; double-stranded, linear
  hypothetical: NO
  original source individual isolate: -10 region consensus sequence
tataat

SEQ ID NO: 627 - DNA (genomic), 242 bp; double-stranded, linear
  hypothetical: NO
  original source individual isolate: HIV-1, LTR sequence, Figure 28
gttagagtggaggtttgacagccgcctagcatttcatcacatggcccgagagctgcatccggagtacttcaagaactgctgacatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctc

SEQ ID NO: 628 - DNA (genomic), 8 bp; double-stranded, linear
  hypothetical: NO
  original source individual isolate: a TFIID binding site
cctgcata

SEQ ID NO: 629 - DNA (genomic), 8 bp; double-stranded, linear
  hypothetical: NO
  original source individual isolate: a TFIID binding site
aagcagct

SEQ ID NO: 630 - DNA, 14 bp; double-stranded, linear
  hypothetical: NO
  original source individual isolate: Oligonucleotide, Figure 29A
gcagaattctgcag

SEQ ID NO: 631 - DNA, 38 bp; double-stranded, linear
  hypothetical: NO
  original source individual isolate: Oligonucleotide, Figure 29A
gcagaattctgcagcgttcgcactttctagagctcagg

SEQ ID NO: 632 - DNA, 13 bp; double-stranded, linear
  hypothetical: NO
  original source individual isolate: Oligonucleotide, Figure 29A
agatctcgagtcc

SEQ ID NO: 633 - DNA, 42 bp; double-stranded, linear
  hypothetical: NO
  original source individual isolate: Oligonucleotide, Figure 29B
gcagaattctgcagnnnncgttcgcactttctagagctcagg

SEQ ID NO: 634 - DNA, 46 bp; double-stranded, linear
  hypothetical: NO
  original source individual isolate: Oligonucleotide, Figure 29C
gcagaattctgcagnnnnnnnncgttcgcactttctagagctcagg

SEQ ID NO: 635 - DNA, 46 bp; double-stranded, linear
  hypothetical: NO
  original source individual isolate: Oligonucleotide, Figure 29D
gcagaattctgcagcgttcgcacttnnnnnnnntctagagctcagg

SEQ ID NO: 636 - DNA, 14 bp; double-stranded, linear
  hypothetical: NO
  original source individual isolate: Oligonucleotide, Figure 30
cgtgaattctgcag

SEQ ID NO: 637 - DNA, 17 bp; double-stranded, linear
  hypothetical: NO
  original source individual isolate: Oligonucleotide, Figure 30
cgtgaattctgcagatg

SEQ ID NO: 638 - DNA, 54 bp; double-stranded, linear
  hypothetical: NO
  original source individual isolate: Oligonucleotide, Figure 30
cgtgaattctgcagatgaggtaccnnnnnncgttcgcactttctagagctctcc

SEQ ID NO: 639 - DNA, 18 bp; double-stranded, linear
  hypothetical: NO
  original source individual isolate: Oligonucleotide, Figure 30
gtgaaagatctcgagagg

SEQ ID NO: 640 - DNA, 14 bp; double-stranded, linear
  hypothetical: NO
  original source individual isolate: Oligonucleotide, Figure 30
aagatctcgagagg

SEQ ID NO: 641 - DNA (genomic), 11 bp; double-stranded, linear
  hypothetical: NO
  anti-sense: NO
  original source individual isolate: UL9 BINDING SITE, HSV oriS
cgttctcactt

SEQ ID NO: 642 - DNA, 12 bp; double-stranded, linear
  hypothetical: NO
  anti-sense: NO
  original source individual isolate: Trimeric test oligonucleotide
acgtacgtacgt

SEQ ID NO: 643 - DNA, 17 bp; double-stranded, linear
  hypothetical: NO
  anti-sense: NO
  original source individual isolate: Figure 12 test oligonucleotide
agctttcgcacttagct

SEQ ID NO: 644 - DNA, 17 bp; double-stranded, linear
  hypothetical: NO
  anti-sense: NO
  original source individual isolate: Figure 12 test oligonucleotide
agcattcgcacttagca

SEQ ID NO: 645 - DNA, 17 bp; double-stranded, linear
  hypothetical: NO
  anti-sense: NO
  original source individual isolate: Figure 12 test oligonucleotide
agccttcgcacttagcc

SEQ ID NO: 646 - DNA, 17 bp; double-stranded, linear
  hypothetical: NO
  anti-sense: NO
  original source individual isolate: Figure 12 test oligonucleotide
agcgttcgcacttagcg

SEQ ID NO: 647 - DNA, 17 bp; double-stranded, linear
  hypothetical: NO
  anti-sense: NO
  original source individual isolate: Figure 12 test oligonucleotide
tgctttcgcactttgct

SEQ ID NO: 648 - DNA, 17 bp; double-stranded, linear
  hypothetical: NO
  anti-sense: NO
  original source individual isolate: Figure 12 test oligonucleotide
tgcattcgcactttgca

SEQ ID NO: 649 - DNA, 17 bp; double-stranded, linear
  hypothetical: NO
  anti-sense: NO
  original source individual isolate: Figure 12 test oligonucleotide
tgccttcgcactttgcc

SEQ ID NO: 650 - DNA, 17 bp; double-stranded, linear
  hypothetical: NO
  anti-sense: NO
  original source individual isolate: Figure 12 test oligonucleotide
tgcgttcgcactttgcg

SEQ ID NO: 651 - DNA, 17 bp; double-stranded, linear
  hypothetical: NO
  anti-sense: NO
  original source individual isolate: Figure 12 test oligonucleotide
ccatttcgcacttccat

SEQ ID NO: 652 - DNA, 17 bp; double-stranded, linear
  hypothetical: NO
  anti-sense: NO
  original source individual isolate: Figure 12 test oligonucleotide
ccctttcgcacttccct

SEQ ID NO: 653 - DNA, 17 bp; double-stranded, linear
  hypothetical: NO
  anti-sense: NO
  original source individual isolate: Figure 12 test oligonucleotide
ccgtttcgcacttccgt

SEQ ID NO: 654 - DNA, 17 bp; double-stranded, linear
  hypothetical: NO
  anti-sense: NO
  original source individual isolate: Figure 12 test oligonucleotide
ccttttcgcacttcctt

SEQ ID NO: 655 - DNA, 9 bp; double-stranded, linear
  hypothetical: NO
  anti-sense: NO
  original source individual isolate: Figure 26 test oligonucleotide
ttccnttcc

SEQ ID NO: 656 - DNA, 10 bp; double-stranded, linear
  hypothetical: NO
  anti-sense: NO
  original source individual isolate: Figure 26 test oligonucleotide
ttccnnttcc

SEQ ID NO: 657 - DNA, 11 bp; double-stranded, linear
  hypothetical: NO
  anti-sense: NO
  original source individual isolate: Figure 26 test oligonucleotide
ttccnnnttcc

SEQ ID NO: 658 - DNA, 12 bp; double-stranded, linear
  hypothetical: NO
  anti-sense: NO
  original source individual isolate: Figure 26 test oligonucleotide
ttccnnnnttcc

SEQ ID NO: 659 - DNA, 15 bp; double-stranded, linear
  hypothetical: NO
  anti-sense: NO
  original source individual isolate: Figure 31 test oligonucleotide
cgttcgcacttttac

SEQ ID NO: 660 - DNA, 15 bp; double-stranded, linear
  hypothetical: NO
  anti-sense: NO
  original source individual isolate: Figure 31 test oligonucleotide
cgttcgcactttacn

SEQ ID NO: 661 - DNA, 15 bp; double-stranded, linear
  hypothetical: NO
  anti-sense: NO
  original source individual isolate: Figure 31 test oligonucleotide
cgttcgcacttacnn

SEQ ID NO: 662 - DNA, 10 bp; double-stranded, linear
  hypothetical: NO
  anti-sense: NO
  original source individual isolate: Figure 32 test oligonucleotide
cccgggttac

SEQ ID NO: 663 - DNA, 10 bp; double-stranded, linear
  hypothetical: NO
  anti-sense: NO
  original source individual isolate: Figure 32 test oligonucleotide
cccgggtacn

SEQ ID NO: 664 - DNA, 10 bp; double-stranded, linear
  hypothetical: NO
  anti-sense: NO
  original source individual isolate: Figure 32 test oligonucleotide
cccgggacnn

It is claimed:

1. A method of decreasing transcription activity in an actively transcribing duplex DNA template comprising a binding site for a transcription factor and, adjacent to the binding site, a target sequence, where the target sequence is characterized by sequence-preferential binding to a duplex DNA-binding small molecule, the method comprising contacting the duplex DNA with a DNA-binding agent composed of at least one duplex DNA-binding small molecule which binds preferentially to said target sequence, coupled to at least one other duplex DNA-binding small molecule which binds to a non-overlapping region of said target sequence wherein transcription activity is decreased.

* * * * *